United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 32

SEQ ID NO: 398 - DNA, 859646 bp, Homo sapiens
cttcagaaactgaacatactgatttaattggctaagaagtccaaatgctaatactcctaataattagccattccttttgtgttttggtgacatatatcctcatacaatgtatatcaaatggaattttttgatttacacctgacatttcaaagtttccatttttgaattctcctagtcttaagtaagtagaacattgtctcctttgtttgctaggcataacgttttccccaacatctagggctccatgatgcaaaatatcattttgccgatcttctgttccagtatttactttaattttttttattataattggattttcaaatacaatcacaaaaacatctcctgttgaaggtggtttcccccaaaagtactcatcaacactactgtaagccttgcttgcttcataattttcaaacacattcatgttggtgtacagacttgcaggggggttatcaggaatgtcaaatgactcctcttcaaaatcatcatccttcagcttattctccgtccctttgtatgatgaataatagcccatgtgctgaaagagagatggtttaaaacggatcacatttttctgagccaacagaccacggaaatgagtcaatagccaatcacaaggcatttcttgataaaacattaataaaaaatgggccaaacgtgggagatcatgagaatgatagagtttaccaatgtagccaagcttagagaattcaagagttacccagtaagttccttctagggatgcaatgactttcttgatggcagttaagaaattttttgaacatcgaacatcatcttcaagcattacataatagtctgaagtattggcacaaaaattaagcagaaaagcataatctacattttgcttggaacgaaatttgactctatcttctggatcattgtaatttcttttaaggccatctaggattgggtaatactcctctggagcatgtataaccattaatcttcctgcaataatatggtgcgcaaatttctgtgtaatatcctggaccatggcatcacgccaggaagaattaaagtctgctaggtgaaccaccactgaaatttccttcagctcttcatagctggattgctcaaaaattgacttaattgtctcaagtaaatagtttcctttttttcgctttactgaagaaagtccaattgtaagataccctgcaaaaaagaattcagaagcaatacaaatgtgaactagaaatatggaaaaagtaaaagagagaagatatttattcctttgacttgctacttactacatattaagtaaatctagtaaatgactatgcacagaacattttatgattaaagtaataagctaaatatataaaggctgtaagtgcttaatacataatttatattttctatgaaaaataaatagcaccttaatcacaataatgtatgagccctattgctgtgaacatttactgatgaaattctaaaaacatggtttaaagtgttctgcagcttaatattctcatatacgcccattagagaaggtagacaggtacctagataacatacaagttactttttaaagataaagtaaaaaaaatgctttttctcttttgcaaaaagagaagggcattcacagttaaggctgacaaactagtttcaaatgatacaaaagaaaaataagggtaagtaagtctttcaatcatctttaaattttttatagaacacatcacatattttcagttttcttttttttgctgtcattatgttgtactagaattcgtaattggacttcacaattttatcttgaaatgtacatagtatattaattagaaagcaaacaatattataagacacattcaaaaaactttaatgctacattgttccaagacataagcaccactttaaaaaattttgaaacacactttatagtaattttgcctgaataactttttattcagacatttataatctaaaattaggaattagatatgtttagagaataaaataaaaccctgagaaaagacagctcacctctgagaagggttagaggtctttctattgaaatattttcactttttaaagctcattctgatattaatcagaattgaataacatttctaagccactatttagaaaatggggaaatctatatacaacaagatcatcgttttaatatagcacctgtataatgcggtttgtatgatattgaaaaaagccccattccaaaaacagtttgtcagagagattgtgatttacacatttcgtttaaataccttggcttacaactcagacttctattgaaacacaatatgttatctagtaccattaaacttgaagccaccaaacttcattaataatagccaatgcttatggaatgctgtctacataagaggcaggagtttgggcattttatctgtaatatgcatcttaaatgttcaaaacggtcttttgggataggtttgctattaccatcattctgctttacagatagggacactaagtcacggtgagatgaggtgactcatgcaaggtggtacacttagtaggtgatgctgcaacaggattcaaactgtctcactcttttatcctctgtgttacattgcctctggtagaaagcagttggcatgtgtgccaataaacattagtaaatttagcatgggaaaaggtaatcagtaatgttcaagcaaaggtggtgtaacagagatgaaaaatgaatggcagtcttagacaattagaaagaagcctaagaacagtagacatttcaaatggtagaatgaaaggaaatgagatataaagaaatctaaattaatttaataatttcctcaacctagtgataacaaatacactcacataaacaagtcttaaaagagaggtcaatttttgtggtcttcacataatttattaagatcatgatagcactgtattttattctaagattcatggtttttttgtttttgtttttgtttttttgaaatggagtcttgctctgttgcccaggctggaatgcagtggtgcgaactcagctcactgcagcctccacctcccaggttcaggcgattcttgtgccttggcctcctcagcctcctgagtagctggaattacaggtgtacacgaccatgcctggttaatttttgtacttttagtagagaaggggtttcaccatgttggccaggcttgtcttgaacacctggcctcaagtgatacacttgccttggcctcccaaagtgctgggattacaggcatgagccaccaaacccagcctaagatttatattttacacattgaaacatttaaaaatcaggctgcatactaaaatcaacagcgttataattaaaattggtaatgcttatactttcttagtggtatgctaattagataatggtactttttgtaagctatggtgtcttagaaatatagtatgttacttcttggctccaaatatatttttttaactgactgcagtgtgttgaatagtttcctccaaaaattcatgtctacttggaacctcagaatgtaattttattagtaaatttgatctttgcagatataattagttaaggatcttgagctgcaataattctggatttagatgtggaccataaattcaataacttgtgtccttataaaaagaggaaaagacacagaaagacaaagagaagaaggccattgatgatggaggcaggaattggagtgatgccccaaagtcaaagagtaccagaagcaaagtcaccagaagctgaaaggggcaaggattctcccttagaactttcagagggagtggggacctgccagcaccttgattttaacctctggcttccagaaccacgagagaataaattgctctttttaaaagccagtcactttgtggtaattcgttatggcagacctaggaaactaaaacactgagtttcattaattaaaaagttgtggcaagtcataaaaccaaactgttaagaggttagaaaatgtagcaatatgaacataggaatttttaaaagttaacttctaaattttaaagtaaattgatttttttctagtcactctataccatcctacaacaaaatctcaagagactcacattacgattaggcattttatttaatttttttgttattaagtgtactgggtcagtgagtatagtagttggcaatttgtgaagaaacattgaagttttgcccaaataatttattatattagtaaagcccttaagcctttttactatacatgtgaaactatcattattttaatgcaaaatattttatgtattctttatttaaatgtttaaggatacttacgctttctttgtaaaggtgtggcagctaggtagcgataggtgacatttatggctcctgagaaattagataaatccttgaaagtatgaacatagcgttctgaattcagttgatgtgtggatgtttcccttataagttgtttgtctccttcctaaataccaagaaagaagcaaggaaaatatataaataatagatggtcatggattaaataaagtttcttttttacacaataaatgtacgactacaatatatagtatgcagggttatataaatctcaactactgacgtcataagctgtagctcatcatcactcacctcattttttacctggaggttctgctccagtagctcgctcgcctattttgctgtgtataccacaattacatttgtttttctataggacacattaataatgataatctcttaaaaaaagaatttctacatgaaaactcccactgcctttatgctacttttcaaatttttgacaatcatttaaggatctcaaaattgacagtaatctattttatagtttaatctaaggctagttcccaccatattgcctgatttactcttcctcaagcagtctcaaataaaagatcacacagtgtctccatgattgtgaaactttaggaatgattaggaagatgcagtagtgggcacaatatttggatttttgatactttattaaataagtcacttatgtggctactatctagctgttgagaagggccagttatgggtgctatggcagtaatttttttcatatgtcctaaagtaacctcaaataggatacattagcaccaaattaaggtaatgtgtagatatctatgactaatatttcttatgatagttaagtttgtgtgtgtgtgtgtgtgtgattctattggatgtaatgcccgatccttttatattttagatcccttttatttatttggtgatggattttgcatgtcattaaatcttcaggaaggtttatattcaagaaaacatattcatattcagattaaaatatatcctttacccactaattgcccttctttgatataagctaaatggtaaattttgattatctaatcatcatttgatcaagcctttactggttatacactattaggaaaatgactatttgtttgactcatatgtgatttactagaattggtagaatacatttgagaacaacctaattagaaagaaatatttctctctctctctctttttttttctcaaaatgtgcactctactatgtggttttatttatttatttaatttttttctttgagatggagtctggctctgttgcccaggctggagtgcagtggcatgatctctgctcactataacctccgcctcctaggttcaagccattctcctgcctcagcctcccgagtagctgggattgcaggcacacgccaccatgcccagctaattttagtattttttagtagagatgagtttccgccatgttggccaagctcgtctcaaactcctgacctcaagtgatccactcacctcggcctcccaaagtgctgggattataggtgtgagccagcacacctggccttatgtggatttattttattcagtatagaaagtcaagctaggcatgtgctagctataagactgtagagaaagtaaatggattaaataactctggtcctgctattattttgctgtggtcattaaaaggttaattaaagccttgttctaaaaaattagacaaagctcagatacaagttttacagctgaaacattcaatacttctacttcgcatcaatctcgagtgacaatgaaaaagatgactaactcagattttctaatctatggccagacgtgactattcttagaataaaaactgaaagtagggaccttaactagaggcttccaatatggtccttactaaatcaagattcattctgaatatcttttctgtatatccaagtatgtttataaatccaaatttggtctttaatagtgtatttctctatttcatactgcctttgataatttggaccaagaaatactttagtcctttataaggttcacaatgtgtaaaagtgtggttttgtgtggcttttacacaatgccatgtgtaaaagccacaaactttcaaagtacttgagattaaaccttagatgctaaattacttagaaatatactaattggctatccactgaattctgatgattttaagttctttatacataaatattttcattggtgtttacctgcatacctataaaacatcattaaagtttaaaataaatttagaactgccaaaatgtaactagtgactcagtttagtatcaattattttaatagtaatgtagtgatgtacataattaataatgcctggaagaaatttctgtaaaaagtacagtaattacagcactaaattcattttaccattctattcttaggtgatgttacattctaaggtaagtgcaggatattgaatacctctttaaaaattctatccttaacacataaaatctagaaattttgtgttataagatggagtacattcatcctgatttaaggacataacagaatataaaaagaaatggaacttacatgaaatcactttattaaattctcaggaacaagcttttttatacttttcagcataaataaataatgcaactttcacctgagtcagccttgttggctgctttccagagtcacctacctgaacagccaggctctccctggataccttctttctgtagctactatgctgtagtatatttctcagtaataagacaaagctttatgacaatcattttctggatgggaatgcaattcaatgaactagctgcagactaaatatatacccttgtggctactttgaagatgctcaaagccaagaagctaagttgattgggcatgcagtgtctcttctacttagtttgccttgtaacggtgtttgtctcttacactaagtgcagcttcctttttcacttaaaggcacatatatctctaatacataagcaaatatgctaaactgctaatatgcctagggtttcaggccacaaatggattttctaacaaaaagacgagaatagaatctgttaactaactccagagaccttactacttctaactattcacctgatatctctaagttagaagtactatttcccagtttttaaaaaaggaagacaaaaaagaaagatctactaatatctgtgcgtagcaaattgcatacattgtgataatcgggaagaaagaagaaaaatgagttcagataattttattaaaaaagaaataaacacaggtaaaaagatcaaaagggagatgtgttaaaaagaaattgcattatattcttggagggggccagtttcccatggatactattcatttttagaagaataattgtaatgcaatttaatattaatcattgaaaaagttttcaacttatagccttgaagcaaaattcagctaaaatgcgatttggttaaaaaacatccgtcagtaaatagtaaattgttaaataataaaaatgctatcatcaaacttagaacaagggatgagtgttggaatttagcaattgctttaactcatttttttccaacttttgtaagtattttaaaataataattttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctggggctacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccaataataatttttaaaagctaagaagcaatctgttttctgcacctggactgatttgcaaatttgagtagatatattcctaatataatcacagaaatctcattgagaaagtagctttagtagaagagctacttcattaaatcatattatctacatttgatgactaggaccaatgtttagatagcactgtaaacatttgcaaaacaggaacatagcattttattttctaattgacatatactctactacttcttactcattttatggtgaatttaaacaggttctatttcaaaagacataagggcgttttgcacattcaatggtcctttgggtttgttgaaagtgaaagattaaaattgcactggaaactgtcttataaattcagcaagtaattgaacatagcaagcctccaaccaataacatgtgtttgatttacaagattttatttacttctaccagtagacacagaatcaagaaataaatttttattataaaattgaataattaatcaagagaatctctagttaacttacaatctttcattatcttaagaaaaaaatagcaagaacacatgggccttgttctgttgtccttattatatctcatataactaataggttttaaaaatattcaaaaatgcataacattagtatgtttctcctattttctaagtttgcctaaatcatacctactcaaatcctgtttaatctttgttgatttcagccattgtgcatagactgtggagagaaacattaagggtccacaacatcagaatcactatttgaagacaaaaagcctaggcagagtcaaaatctaggattctggtacaatttcagcatcaaagaacagagataaaggatgcaagatgttttacagaggacttcttaggaatatctgtaccaactaaaatcatatggttgactcataggatatagcatagtatctggaaaataatagttaataaataatctaaagcatttttttttggaaatactctctctcttgttaagacactaatttaaacttttagcatttttgcatgtgaaaatcactttttagttcctgttagttgtaaaggttttgatttctgaaatatataaactgtaatcaggttttgattttctgaaatctataaatattaataataacatacaaattaggacagatattttaggctccattaagatagaaaaagtgaatagcaataatgtctgtattaatctcatcagacatgaaatgatgtgatgataacaataagaaaaaaattgaaactaacatattaatttttcataattagtcagaataagcgcttttgcatattgtcatattttccctaaaaaaacctatttatatgtaatcacctaccaatatttggtatctcattttaactactgaatgatttacacatcaatatctttatctcttgagatcttttcagtgggtacaaatataaaacagagtggccatctaggtctattcaaaattcagataaggtgttacacattgtaataaaatattacttatacaaatagcacaattaaaaagcattgttaattagacaatggaattttgaaaatttcagtgataatatagaaaagtagaggaagcaaggagttatactttctaagcagattttgtttattctatgcatttcaaatggaaaacccaaaatcttaatggctccacatatttattctgcatagtgatgatagctaacttatttgtaattacatgtacatatttggagcacaaaatatacaccattaaaaatattggaacataattcaaaacaagtgtaatgttgatgtatggttaatacaaaaaatagacaatatacatgttataattttgctcaaactaagtcttctccaatagcttgagattgaagttaggctacaatgggactaattcttgtttgacttatgccttattttgaagaaaagacaatcaacctcccaaacttaccagaacatagctatcttcaatgtacaagttcataaaaaggagaaaaatgacaagaactcccaagaatgacactgtagaacgttttctcaggcatctcattttatcaagtatttcaaaaatatgtttcatttgatgaaatttaaacattctcttctgtggaaaagagacacagaattactagcagttggttttggatgcaaatatttctttatcgcatatataaaagtcaggtccttgtaaaatttcatctttcaaatgtttgaattaaaattctgttcccaatttcaaacataaggttggcacagatcattaattaatatgttaacataagatcaatgcagtggtttatattaatgtagagtaaataaaaataaaaagcaagtctcatagttactgacgaaaaaagatgaactttggtcataataatgtaaataaaacaggcctctgatgagaaacagtacaaaagcacaatagaaaaacagtcaagtccactgtcatcagtgaggtataactttaaggtaacatttacctctcatattgtagtataacgaaaatgagaaaaagcagaattatgggcctaatattaatctcagagtaggtgtcaactgaaaatatttaactgggaatctgggtggagtaaagaaaagtgataaagaagttaaggctgtggggtaaatccaaacatatgtttgaaaacttctgggttacaattgctttgcttatttttccaattattcttgttaaatcagggtgaatcctatagtattatattaacatttccttgatatctactacttagtagtttagctgtttgaaataattcatgtactacacaaaggcaaaatgagagtcagaaagattcgtgaaaacctaatttaaaaaaatttttactcttctattttctgatattttccaaccaaagattcctttacattattcattattttataaaaaagtataaacatatctgaagcacttaacaaactagaaaaatcacattttgtgtaaaatcaacacattgataacctgaaaacagagctacttagagttgtgtaatggatctccttgggtttatctttatgatgaagtatttatgtgtaagggagactttagaaagtgaaaaatgtccgtcccctataatcttagaactatgcctagaacatagctggcaaatcttatctcttcaatgaattaatgcaagggagaatttgtgggtccttataaattatagtaaaaatattaggaattagaagaaagtcttaatatataagacttaatatatgacttaataattataagtctaaaaataatttctaaaaaagaattatgaaagtgctatacatattactgtccattttctttgatcatatttttcttaagggttatttttcttataaatttgtagaaattgtaaatatgtgtataaatatgcacacatagatgcacataaatgtatatcctgaggatttgggtgatatatgacatttcaaatagtatgagaagtggtaaaaataatgctttggaggcaatattgtagttctgttatgggatcttcagagtgttgcttttctgatcagaaacctctgtgactggtggcatcttgccagagtccttgtcctgcatcgaggaagaatgaggtattcagacaagtggagggtgagcaagatgaagaggagctttattcagtgttagaaccactcagacaagacccacagtgggtaggtcctctctgtagacaggtcaacctgtcaagtgttcagcacttagcagagaggttagctcctctctgctgctggttgatccaccctcttctcagcagacagggtagctcctctctgcaggtggccactccatcatctctccatcctctcctctgctctggctgaacacggggcttttatgggcctcagagaggaggaagcgcatgccaactgatccatggacagccatgggcgggcccagaaaaggcaccacaagttcccagtctggtctgcaggactggcagcctggcccccaggcttcaggccttcaccagcctgaaggtggggcttcactggggacccacccccttccccccagaagtctgtctgcctcccactactgtccatagtgtccaggctgcttgcaccaatgggcacctgcaggccagtgacaagacaccctcagccccctccttggttatccttcccgcactcgtgggcgcttaaagcctggagggtgctgagatgacaagcagctggcatgtcagcactgcccagagctgacattacaggcatgaatctgagatgctgtgccttgggggaactcagtgtctgggcatggtggctcatgcctcaaatcccagctcttagaggggcagaggtaagaagatagcttgagcccaggagtttgagacctgcctgggcaatatagtgagaccccattctccacaaaaaggaaaaagtttacttcacagttctagcagcagagtttccaggtgagatttcatcagagcaggtccttggaagttttcaccatcctgatgacaatatggcaggggtggtgaccagcgagccatcttcagaagtggccctaccttttcaaagggcagacaaaggtgccactagcaacatacgtttctggccagaaaagcaacaccccaaagatcctgtaacattttgggggctcatccagggtctgcggaaaggtaagtaaaagtggatctgctcttactgtctttctttggagtctctaacttccacaacagtcaaaatgaaagaaaaatactggacatttgtcagtcagttaaaagcgactagcacagctaccaggacttaagacatggagaacagactttctggggatgacactgtcaatcctctatcacctctactgggtgttgagaatgttggctttgtttcaatccagtgtcctttcatgcatatctagctgtcacataggactgaaaggaaatcttggggcaactaagggtatctggccaaggctacaccttggtgttatccaaaggcccctggactaactccagtccctgactgcccattagggtgttggcacttggacctccagtctttcctatcattctttctttctctcttttgtggctgtcaaggttcccatctcttctttatatacaatgttaaatgttaaagatgttgttgcaaactagagatattactgggaagaatgtggaattggctcagtcatcaaaagcataaaatggaaagttaagacaaagcaaagtgtgtgttggtatctgtacataaatttgtggcaaacatgtttttgtcatttcctttgttgccaacttagtgtcaagcactttgaagcacagaacagaaacatggcctcaggaagaaagcttttctgtgaatgtgagggcaaatggtccaaggtcccatgtgctggccttctttgccttgcagggcaattcggacctttgccgagactgtaggattgattaagccctcctagatggccatctcaggagaggctgcaagagacggtcccagggaaatagggaagcaaaccccagaggtgcctccagcaggggaatcaaccccctttgctcttccctatgcgggttctctcttaagcttgccccagcctaaaaatcttcgttttaggcaggtcccagtctcaactgctccaataacagatgcctggtgaatatggccccattaaggtccaggtccccttttcaaattaaagggggtcttggcaagttttcaaatggtcctgacaggtatatagaggctttctagaacttaacctaagtaattgagctctcctggaaggatgtcgtgttacttttgagtcaaatcctgaccaccactgaaaagcagggaatcctgcaagtggcagagaattttggaaatgagctttatatcttatatagggccagggatggggaggagttggaagaatggcagtgccattggaggaccagttggaagaatggcaataccattggaggacaaaatgagcccctcatgataaaatgagagaagggaggaggaaacactttcaggtttgcatactgcaaggcttacaagggattgggtccagcctctcaactgcactgagctatccatggtagaccagggattggatgggagtcacactgccttcatcagtggggctggaggggccttggtgaagtgtgattctccatctcctgatttggttaagggacagctggtcctagggggatgagttaatcacacaggtggcccctgatgtcaggagggggctgcaaaaatgggctgtgggaccagatggtactttggagggccttctgggagtggtcacctcagtattttgcagtgggaaccatgaggaaatccagaaaagagaggggagatacaggaaaaaggcagaggcttccagtagccaccttgtggacccgcagaccccagagtccccaagatgcatttgttgactgccacaaatgtggtaggagggactgtctagacagcaggaggaggccaggtagtggaggccagtgcctacgcaggcacccctgagcctgtgtagatggtggcatggggtccttccagggtcctcaagggtgcagaccgcagagaagtctggattctgcacctgggagggcagctgcagtggctcctagggagggcgaggctcctgcctgagcagtggcatgggaggcccaggccagcctccctgctgcagctggcatcttggcagcagccactcttgatgggccactgctaccattagttctgtctacaataatttgaagtagaataaaacaacaacaaaaccccaggatataattcccaagagttgacaaagaaatacagaagtccttagagaataatgacagtcgtctaaattctaatatccaaattctgcaaattgtaatcctctcaaatccattcacaatacagaatacaaataaagtttccatggtgtatacccccagagtaactatgatacagacaattagcacaaactttaattttcatttaattgagaacatttacacccattgtcagcagaataggctgagaagcccaaaccagagcaaacaaaagatcaaaagacagaacaaaataaatgtcatttattaaacaaactatgctagactgcaggccgttaaaaattaaagaagctaataaagccattcacactcctcccccacctcaaacatagaattattttctacaccttggtttaggaaagtttttaaaaaaatccccccccagccgccaaaaaacaaacaaaaaacaaaaaacaaaaaaacactcggacacccaaaaccagactgacaaaattactatgaaaaggaaaacaaaatagctgatttcaagtagggagaacagactccgggattagtccatatttttattgtgatatgaagcaagaaagctctcaagattagtggagacatatctaaaggacatagaaaatggcttgaaaaggcttccattaaggaattttgggaaaactgaagattaaaatttatgggctatgattgatagtaaaatactgaataaatataaattaatgatgaaatggtaattataaatggaaaagaaagaaaaagtaagaaacctcatttgctactactgaaggtgaaaactttaccatcttcagtcactagaaattggtaactgaaagtattaacatttttacccagcatttctagaagacactatgttttatccacagttgatgactttttttctaatattggacaacaggcagcacagggcaatatccccaagtgaagaaaccaaataggtaagccctgtgatttttcctgcttgctgtcaagaggcggtttccaaaaggcagtacagggacagtgaatccaaacagaacgtagagatcttgccaattaggagacagaaataataatttgggggagataaaggtacctagaatttgagtggcagaatatttaagagaacaagtgacagaagagagactcagaattctgcagacggctcttcaaatctttgagttgatactggtatgtcatgtgtgtcatgaaacttcataagactagagaaagaaccataaaaaagtagtaggccaaacagttcctgaagcttatacagtgttggagatagtttgtgtgtccataagccaagtttgtgcgtccatcagccagcaaacttggactggacattaaaaaactggacattaaaaagaatactcagaggccagctgcggtacctcatgcctgtattctcaaaactttggaaggctgaggcaggaggagagcttgagcccaggacattgagaccaccctgggcaacatagtgagaccccatctttacaaaatataagaaaactagcctcgtgtgttggtatacatctgtagtcccagctacttgggagactgaggcaggagcattactcaagcctgggaggtcaagcctgcatgcagtgagctgtaattgtgccactgcactccagcctaggcaacagaataacaccctgtctcaaaacaaacaacaacaaaaagaatactcagaagcatattaccttagtatttgggccaatactctctaggcctgtcctaatgaaagcttaacaacaagcatcaacagcatcaaattattttgcataacttaactccatactagtacaaagtacagcactctttaaacatataggacaatgtctagaacttaagaacataaaaatcacaatatccaggatccagcaaaaattaccatttaaatcatggacaatatggtctataactaggctgaaactaatcagagagaaaaaaatcaagacataactgagatgatagaattaaaagaaaaaggatattaaaaaggctatcataaatatgtcccataggctcaaaatagaagaacaatgataattttaaggagagaaatgaaatatttaaataaaaacaaaaacaatttctagggatgaaaaattttatgtgcgaaatgcaaatacactggctagtagataaagaatagcaggagaaaagatacaacggtagaaataatacaaataaagcacagagagagggacaaacatccagccaaactgctgtctaaattctgagtcacaggaaaagtgagatcataaatgttgtaaggcattaaatttcagagtgttttcttcggcaacaatagacaactgatatagctatctacaggaaactcattttaatgataaagacaaaaaatgagttaataataaaagaaaagatagagataaacattaatcaaaggaaagctggactgggtatattaatataatacaaagcaaacatttagtaattaatgaaagtatcaatttttcaaaggaagcataaatgtacatgcaataaataagagtttcaaaatacctaaacaaaactgacataagggaaaggataaaaaagggaataaataaaggaggaagaaaggaaagaaagagaataaataaattcattcattttcaatatatgaatatcgaagtcctctatttaaatattcctccctcaataattgactgaacatgcaaatacaaaaccagtaaatgtcaaaaatatttaaaacactatcaaataaattaatctacttgggatttatgaaacactccacccaacaatagcagtgtataaatctgttttcatgctgctgataaagatatacccaagacagggcaatttacaacagaaagaggtttaatggacttacagttccacatggctgaggaggcctcacaatcatggtggaaggcaagaaggagcaagtcacatcttacatggatggcagcaggcaaagagagagattttgcaggggaactcctctttataaaaccatcagatattgtgagacttatttactatcgtgagaacagcacaagaaagacctgcctctgtgattcaattaccttccccttggtccctcccttgacacgtgggaattgtgggagttacaattcaagatgagatttgggtggggaaccagccaaaccatatcattccacctcccaaatcccatgtcctcacattccaaaacaatctcgccttcccaacagtccctcaaagtctaaactcgtttcagcattaactcaaaagtccacagtccaaagtctcatccgagacaaggcaagtaccttcagcctatgagactgtaaaatcaaagcaagctagttactgcctagatacaatggaggtacaggcattgggtaaatacagccattacaaatggaagaaattggtcaaaacaaaggggtacaggccccatgcaagtccaaaatccagcaaggcagtcaaatcttaaggctccaaaattatctcctttgactcaaggtctcacatccaggtcatgctgatgcaaaaggttggtttccatggtcttggacagctctgccccaatggctttgcaaggtacggcctcccttcaggctgccttcatgggttagcataaagtgtttgtggcttttccaggtgcacagtgcaagctgtcagtggatctaccattctggggtctggaggatggtggtcctcttctcacagcaccactacatagtgctccagtagggactcagtgtgggggctctgaccccacatttcccttctgcactgccctagcagaggttctctatgagggccctgcccctgcagcaaacttctatctggatatccaggtgtttccatacatcctctgaaatctatgcagaggttcccaaaccctgattcttcacttccatgcactctcaggctcaataccatatggaagctgccaaggcttggggcttgcaccctctgaagcaatggcccaagctctatgttggtccctttcagccatggctagagtggctgggattcagggcacctagtccctaggctgcacacagcactgggaatctgggtctcacctatgaaaccattttttcctcctgggcctccagacctgtgatggaaggggctgccatgaagacctctgacttgacctggagacattttccctattgtcttggtgattacattctgctcctcattacttatgcaaatttctgcagctggcttgcgtttctcttcagaaaatgggattttcttttctatcgcattgtcaagctgcaaattttctgaacttttatgctttgcttcccttataaaactgaatgcctttaacagcacacaagtcacctcttgaatgccttgctgcttagaaatttcttccactagatacactaaatcatctttctcaagttcaaagttccataaatctctaaggcagggataaaatgctgccagtctctttcctaaaacataacaagagtcacttttgctccagttcccaacaagttcttcttctccatctgagaccatctcaatgtggatttcatcatccacatccctatcagcattttgggcaaagccattcaacaagtctctaggaagttccaaaattttccatgtttttctatcttcttctgagccccccaaactgttccaacccctgcctgttacccatttccaaagttgtttccacatttttgggtatcttttcagcagcgctccccactctactgctaccaatttactgtattagtccattttcacagtgctgataaagacatacctgagactgggcaatttacaaaagaaagaggtttaatggacttacagttccacatggctggggagtcctcacaaacatggtggaaggcaagaaagaacaagtcatgtcttacatggatggcaacaggcaaagagagcttgtgcagaggaactcctctttataaaaccatcagatctcatgagacttattcactatcatgagaacagcatgagaaagacctgccaccatgattccattgcctttcactggctgcctcccatgacacatggcaattgtgggagttgcagttcaagatgagatttgggtggggacacagccaaaccatatcaagcagaatacacattcttttcaaatgcacatagaagattttctaaaacagacctgatttggggatgacaagtctcaatacatttaaagaaatcgaaattatatacaaatgttcacaatgtgtctccattactggatatatatccaaaggaagacaaataaatatgttagagaagtatctgtactcccctgtgtattgcagcactattcacaatagccaagataaggaatcaacagaagtgccatatgcagatgaataggtaaagaaaatgtgtgtgtgtgtgtgtgtatatatatatatatatatatatatacatacacaatggaatactatttagccataaaatagaatgaatactatttagccataaaatagaatggaatactatttagccataaaatagaatgaaatcctgtcatttgcagcaacacagatgaaaccagaatgcacatgttaagtgaagtaagccaggcacaggaaaacaaagactgcatgatctaacttatttgtgaaatctaaaaaagttgaactcgtaaaagcagagagtagaatagtgattaccagaggctgggaggggagatggaagctgggttggtgagaggtacagttacaattagacaggaagtataagttcttgcagtctattacacattagggtgactacagctaataacaaagcagtgtatatttcaagatatcctgaagagaagatttggaatgttatcaccgaaaaaactttaaagtgacagatatgctaattaccttaatgtgatcattgtacaatgtatacacatgcattgaaatatcacactgtaccacacaaatatgtaaaattgtgtcaattataaatacaaataattttaaaagaaattagaaaaaagggtaaactaaccccaaagtaagctacaaaaagagcaaattaggcaaaaagtaaacaaaataaaaatgacaaaagtaaaggtaaaaatcaatgaataagaaaaaatagaaacaaatgctggtccttcaaaaagatcaataaaatatatattcctctagccatactgatcaagaaaaaagacattattaatatcatgaatgagacacatgtcatatcactaaagattctacaggataatggtatattttgaaaaaatatgctaataagtttgacaagttaaacaaaatggagaaattccttgcaacacagaaaaattatttatctattaataaaattgaataagcagttaaaacatccctctcaaaacattccaggtccatatgtcttcactagtgaattctaccaaatattttaaggaaaaagtatacctcctctacacaagctactccagaaaatagaagagaagtaaataatttatattttccagatctaataaagcatttttattaaattttatttgataacattttaagtaattttatgaatagtaggagtaaacatgaatatgttgaaaaacaactttattagaaataatgttaagcatctaaacatagctaacccagattttctttctaatttttccaattttgaaagtatatgtctaccaaatctacgatgcctcatcaactgctccccaactatcatgccagaacctgcaacatatccttcttgtaagctgtggtttcatatttctagtatatttctaacaggctcatgcttatcactagtttggattattcctgcgtttgcaccatcaagacactatacacttgggaatttcaatggctcataattttgttgaagggaggacaatttccttatcctgtcaaatcagtttagccagaattccccatcctccatatctgatccctcaatatctgatcaaatttctcacccaccactatctcccaggtaatatatgatcaccctgacctgccatcagtaagaatcctttcaagccagtttagcaaaaaattatctaccctcttaatgattttcaatccactaacttgcattcttttccttggctataaattccaacttgtctttgttgtattcagcattgagaacaatctctttctcctacttcaataccccatggcagtagacccttgaaatcccttgaataaagtctaaattgccatctttaaccagtgttataattttttctttaacagtttttgctgctatgacttgtataggatcaaattcattattggattcccaatcttctgacccagaatcccaagcacctacctttgaagctttcgtcttcacttctggttgattgatggatgagccattggtgatttcgactcctgagccagtgctccaaatgataagtctgttgaagcacagtgagggctgagagagcctgagtacactatacagaggctgagttagtcctgtttctttttgtaagaagttggtatagtcacatgcttctctgttaggaaggtactggctgaattgtaaatcttacttcctgtttctgtctttgagtgggaatttacttcttgaatccctgagctgaaatattttccttggttctttgtgaggcaactctgttctatttgatcctatttctcccacggtaactttttagtcaacggaaacccccttcttaaactctcactgatcgtatactccacttcctttcttgtggtcatggttttgttaaggataatttgagacttcaggatctctttgggaaactgaagattttcccgaagtgagtcctctgagatctcttccttcccattgcttctgctcctccttcatccttttactaccttcaatcttcccttcagctttcttgaatcttttgatatgtgcctcttcagacctctttcctctgtctacctgtcctcccagacgtttttccttcctgcttcagcccttcagtcacctgaactttaggtctcctatttccatcataactttcaagggactctaggaccccaaaagcaattgtctgaggttgaaaaaggaaaaaaaaaggctgattgaaaaatagattggatattttatccagatgaggctttggagacatccagataggtgcttgatgttctttcagtttcttgcctaaaatgtggtcacagcctccataacattgcatgtatgggcaaaagaaaatcttaaatgtgtcttctccacaaatattggctaaaagctttagtcctcatattgagaaggtaaccttaacttgttccatctgtcagaaacacaatgaataaaactataaagtagaggaaataagagagtattactgtgttgtctaactcctggctaaagtttcagaataaaacctttaagatctcttataatatatgtatacattacatttatatacagatatatatgcaatatatattcttatattttatacatataggtatagaatatacatatatcccattctatgtatatacagaatatacatatatcccattctatatatatagaatatatattacatatatgtatgagtaatatatatgattatatatcataatatatatgagatttatctgtggatggtattatcaaattacttagtactttctttttgtgttttagagacagattctcacgctgtcactcaggctggagtgcagtggtgcaatcacagctcactgcagcctcggattcctgagttcaagggatactcttgccttagtatcccaagtagctgggactacaggcgtccgcaatcatgcccagctaattttcaatttttgtttagagatggggtctcaccatgttgcccaggctggtccagaactcctgggctcaagcaatcctcctacctttgtctcccaaagtgtcaggattacaggtgtgagccaccacacctggcctaaaatttcttaaattctgttccaattttcagtgataaatgtgtgcttatataaggtaaatatttctaaaactctcagaaactaattcaaatgcttttcaaattcacatgaaatggacgtatatttggcaattaatactagcttcatattgtttgtttcgtaaaaacagctacattttctgatatatcaacattcagtataatatgaatacacatttttattccacttgggcttactagttgaatcaggtaatatgtcttctagatgcttaggattaaaaaaattatcagttcgaccttagaataagtgtacaagtaaagatgcagtaaagaagagttgtttgatgcccattacttcatatttctcaagacagccataaaaccaaaaacctgtgtgtttaacttctttggtttttgcttttgtgatgcttgcctaacatgatgatgttaactgtaaaaacagttaacagggaagtaaattgagattatggctagctttgcctggtgttgcaatatagttgctgaaaacggtttccaaattatttttgttaacttgaagttttaatgtttttctaagctgtattaagtaataaatactcactaaatatctaggtcattacgaagttttgtgaagttgtgaagttttgtgaagaagaagaagaagaagaagaagaagagggagaaagctcaatgctttattaatgcaaaactagatttttttttctgtggaaaatgccagttttcttggattacagtaaaaggcctttttgttcattttaccttttaagtaatcttcctaggaagccaagattttgtgtcttatcaagacagttttctatgtttatgttaacctttaccattggccttgattatttaagagaactgagagcttgcaatttaaaagcactaaagtattttacatgttttacagtgttgccttttcaaaacaaatcttaagtgaaatcttgtttttgaactgatcttgaaatttctcaaagggaccctaaaaaatgtcaaaaaatttgttctttcaccttgtaaagagaaatactaaaaataatttggtttatttaattgatacattgcattgcatgaaaagacactttcaaataagaaaagatactttaactttccctagattatatttttgtatgggcaaacattattaggtattttagaaatcatataaatttcctagaaatttatcaatatccctgctgtccacaatatctcttagtttaatgtcatcagtggtggctctaattattattgtatgcctcaaaaatagccaaattatcttgtcatttgcatcatttttatgttgaactctcattatatgttaatttccattttaaattttttgtcattcacatatattctgattcttctctgaaaatatttgcaatcagctacaagccataatgcttcatgatggtgttgattaatttagagaccatagtactgaattaaggattttcagaactagagtagacaagccaatgggttcatgaaatttctaacccaagagcaaggagaacaagaattatttgttctgatggacaataatgaagtgaagaagagtgattatggttttgtttgacagtttgttggttcttaaatgtcctattttgtggatataagcactcccttcctttttctcttatttatggaaccacagaaccagcccaatctggttcaactttgaataataaaatggtgagttatttttcagttgccatgggttctgggttgcaatttatgtaaactgcttatgctcagatgaaccacatgtgtaactgtaggcagaaactaaattctaggaccaagaaacagggactgaattaagaaggggacatctcatgacataattcaattagatcaagtcctggcatcaccccatggcacaatccagtcggatcatgcctcatggcatcatctcgttgtaagatcaaatcagatcacacctcgttaccctctgcctataaaacctgccccagtcaccagcctgaagagacagatttggtcactgccttgtgtctccttgccaataaactcatgataaaacctttattttctcaaagacttgtgccacattgggcagagaagccattgcttactcagtaacatttacacttgtaaaaatcagtagattatacttttgtacatataatattttctccctgatccttccagaatttgtaaactattgagtattcttattttcctggcaatatagttatttacatgaatttaataagaatctgttcttgtaacagaacacaattggaaacattggttatatttataaggttttgactgcaatgtcatatttgagaatgatgtgtatagaatctgagttaggaactgaggttaactttataataaggaacaatttttacaaagctatcttgaaaaagctggcccaataataattggcttctagggttcttagccttacagatgagtaaggaagatcacttcctagcaggcccagggaagatgggctatcttgggaacctcaagaagacaggaattcattcaaatctgtaagtaccagaagtgaagtctgatggctagttcttggctggacttcttagcttcaaaaggtttttgaaattataacctgagattccttatgaaaagttccagcaaagaaaactcaaaaagacctatgtggtcaattaccattcttcctttccttatgtaaataatcaggtcaaatctaatgagaccagatttattttgtcttttaaaagagaataacctcattttggttatctttgataaaaaataagtgtgactagagagatacattttatgttccagtggaaaaatatagtgcactcttgtgagttctcgattattctagcttttttccagtatccgtctacaacttccaattttctctcaccctcctgacttggagtcaatgagatgtaaaactgcccttttttcaaaactctgcaagctgaagctcgactatgtgatataaacatcatggaaatcactgtaacagattatgtatggacagcctttgtgcttgttgctgtgtgggccactcagaatgttcatggaaacacttcatgctgtcactgaaaacattcaacctgcaaacccagaagctttgtcagtttgccgctgccatccccacttccctatctaaagattcttcaagctcaaatcaagatgtcttcttgaatggcggccctgtggaatcagaaactgggtttctaaccattaatttttttgttaattttcatagaaattcccctcattaaattcctgactgctaacccatccagcaaatatattatactaccatatcccaacagatgtttcagctggtcctcaatgagcaaaagataactcaaaaagaaacagacttgttttgttcaatggaaaaaagaatatttcttttcttgaacaagaggagggactgacaaagaatctctccttgactaaactttaatcagtctcctctgagctgaagtaggccccatgttgggcatatcctccaagagcctagttttagcacttaccctgtagagtcggcttagccaaaatcccctgctctccatatttcatccctctcaacatctgatcaaatttttcatccaccaccatccctcaagtaatgactgacaaatctatcttgccttaagcaagaaacttactgggtcatttttgcaaataattactctaccctcttagtgatttttccatccactgactcacatcctgctccttggctataaccttctacttttccttttgtattcagagtttagcccaatctctgtcccctactacaaaacccattgcattagcctccatgaagttccttgaataaagtctactttatcagtaataagggtcatgatgaatcattttctttctttaacagcatctaagaatctgattcatctaataattgtgaatcatataattcctctaataattatgactaatataaagagtatcttcctctgtttatatttttctctttatcattatcataggaaaattaaaaattctgcattttcaactgtgttcaatgaatggttaaatatacagattaaaggataatgtctttagaattttacttacatacatgaaagactgcaatattttgggcagcacaataccaatagtgaagaatactatcctgaaatggggctttatttcaatactgcatcttccacctagatgagtccatcattcttccattttctaattatttcaatctatgctttagcacagttagaataatttatatgtgatgaaatactctctattaacatgaaatagtaagatatttcaggatataaaaaatataagatcaccatgatctggtagtgtatcataagatttaccaaaaggtctaatgggctcatatgttaattataatttataatgaatgtgccatttaaacaagaataagttttctctttttttgtctggtagaattcaaataaagtataaatatcatcatacgacaaactttaaaacaaaaatgtgtttaaacaaacagaaaaaaacaataaaaacaaaaaactaattggtttcaacagactctaatgatttatcaaaggtgaacagtatttttcgatgagcagccatttttaatgttgttgataaagtcaagttcattaattttttatggtattgcttttgtgtattctaacaaaccattgcctaattagtatcatggaaatattctcatatgctttcttctagaggctttatagttttagtttttagggtaggtataataaccatcttaaattaagtgtatggtgtgaagaagaggatgaagtcccttttctatcccatttattcagttgtattgggtgcctttgttgaaaatcagttggatatatatgtgtggttatatgtttgaaatctctattaggtatatgtctctatttatttttctttatgtcaatatcatactatctggattactatctgaaatatgatgatgtgagtcatttgcattactatggaagttttatcatcaattgtcaattttgacaaaaacaatctagaatttttattaaaaatttgttgagtctgtaaattattatacaatcaactaaccaatttctactgaaaaactatttagaatttgagaatttgctggttgtacaaataaattatttgaatctaaaaatacatttttctcaacatggtatttatttacatttattcaggtcatctttaatttgtctgagcaatggttttatttttcagtgatgctgacatctttcatgcctgtaaaatttattattaataattttatcttttttctattataacaagtgctttctgtaaacatgttttctgctactacatagaaattcaatttatttttctatattgatgccttggatcctgtgaccttgttaaatttaaccatcatgatattgacaagcaataaagagttttaatatttttttccaatctctaagacttcaacattttgttgctgttattgctgccttatttcaatggcaataagtaaatgggcttccagtaacatgttaaatagaagttattaaaacaaacttttgtgctttgttatgatgttaggaagaaagcgttaagtatttcaatgtaaggtatgaagatagttgtagttttcttacagatgcaccttatcacactgaggacatttgcttctattcctggattgataaggtttgatattgagaataagtgtggaattttgtcaaatattttttctccatctgttgaattgagggagcttttttctcctttattgtgctatacgatggattatacttgctgattttgtaatttaaaccaaatagaagtatacattaaataattatataattatttttatatactgttgatttgctaagattttctttctgcatttatgttcttcagaaatattgatatgtaattttcttttttattttccaatattgttgtcagcttttgctattggagtgccaatctcagagaaaccttaagtctagggctaattttgccttacagctaaggcaatacccttctgagtactctatctaatgacctgcatattacaaactttttcatttcagttaagaattactcttagaataattctcttttagaataattactctcagaaataagaattactcttcttttctgtgtgcgttccagaagacattgcaactgttcctttccagtgattctttagtagccttgaatagtttcttcacacacatgccataatgaatgctcagacataaaataatccctttctctctctctccctccctgcagttgtgttttccatgcagctttctcctctctagtatctgcttgtgaattacagccactgcagaatccaaatatcttagctatgtctcttcaactcagagaaatcagttgtgtctttgagttcactctccttgtattgcaacccagaacctctagccagtaagctacgaaaatgacctcatttcccaccccatccccccaatcaggaatcactgccttgttctgcctcttttataatgtctaaattttgttttacttttattaattctgcttttcttttagttgtttaaggatagaggcaaatctgacccctatttctccatcatggtaagaagcatatttctggttataagattttttgcctacacattctttcctttattttcttgaaaaacgttgctccattattgtcttgctttctatcttactgctgaaaaatctaatcctacctggttttctttccattataaatgccttgacaaatgtaaatgagttggttgtgtagcttagaggcttgctgaatattttatctttaaagtggtatcacatatgtcttggggttatcaattcttggtaaagtactcaagaattactgaagaaattcagaaaaatcactcgatcacttgatatttcattgcatatttaattttaaacagacatagggaatatggtgtaagaataatgcataaatgttatatattgtgataatgtcaaaaaatacccaattaaaaatacaagaagatagaaagggggaagtagtctaagtttgtatatctacaccatatagataataggtgtaagtcacagactattatttaaagcaaaacagacatcagaagcaaagttagaaaacaggactaatgaaataaagatgattgtaaaaggtaactacttaaacaaaactgcaagagttcctaaataccaaaatgaatataagaaaaatatctgcaaaactactagtgctatggtttgaatgtttgtcttttttaaaacccatgttgaggatagacatggtggctcatgcctataatcccagcactttggaggctgaggcgggcagatcacgaggtcaagagtttgagaccaacctggacaacatggtgaaaccccgtctctactaaaaatacaaaaattagccatgcgtggtggtgcacacccgtaatctcagttactcaggaggctgagacaggagaattgcttgaaaccgggaggcggaggttgcagtgagctgaggttgtgccattgcactccagcctgagtgacagagcaagactctgtctctaacaaacaaacaaaccaacaaacaaacaaacacacaaaacccatgttgaaagataatccccagtgtaacagtattaaaaggtgaggcctttaacaggtgactggatcatgaggcttctgcccttgtgaatggattaatccattcatggattaatgggctaatggattagtgggttatcacaggaggggttagttatcacaagagtgggtctgttataaaagttagcttgactctcttgtgtctttttagtcttgtgatgccttttgccatgttgtgatgtagcatgaggccctcaccagaagccacccagatgctgctacctgatattggacttcccagacttcagaactgtagaaatacatttctgtatgtataaattacccagtctctgtattctgagatagcaacagaaaacacaccaacacaatcacaaagggaaatataatacaatgagcaactttctaaatcagaaacacagaagatgcaagaagtcaaaattcctaataataggggcctttaattttcacagcccaatatagatcaagaggccaaaaattgccaaatatcacagcagtaaattgcataagtcaagaacttttagagacataagcgcaggtttatgaattcacttcacaaacacagtgaaggaaattaatattcttatctcagaatttcatagtttcaatagtttaaacattagcaaagacagagaatataaaaaatccaaagttatcttttagaattttaattttggtgtgagttttggtcaacaaagcacatatgataggtagagattaagaaagaatattttctgcctgaccatcaaccagtataattcagaatattacaacagaggagagaaccacattacatgagagagatgttgttggcttataatagtatagtagaaaacgggatgagagaattgaagcaagttaattcctaggtagtaggatagggccaataggtagccatttaaacttatattttaaatccatagacactgtaaaaacattagtaacttagggtcccagtgtaaaaaaagtatgttaatataatttgcgaataatactgattactaggaataaacactatattgaacatggcagacacaaactcaccatcctttaccagctccaagtgttaaagtaaaactttggtctcaaatttgcaaccaggtgagcacaccctgataatataaacttccatgtcacatgctactgcctgaaaatagcaatcacacaaatgaagatgagttacttgagcaggagatcttggttccatgttcaaataacattttatctgctagaattttttctttgttttggaataatattacaaaggacaagtacgtttttcttttaaggtcatgagttgattgttacagattaggtttatttgaaaagtcgtaactcatattatattatcatgatttgagtgaactatttctcaggatgatacatcatctttatatacccttaatgtcatagacatttgcttgctaacggcatatcccacgatactttttatttctgttacacccaatgggaaatcctgagcatatttttttactaattatgttgtgttttcaaaaacagcttcatcacaagtttctgatccaaggctattgattacagaacacagttatggaagcaaggctataacaatatccttacttctctgtaccaaatacatgcagcatttgcatgtctggttcaataaggcttaagcagtttttgtttgggaacagaatcatatgcttttttaaagacctgggtgaggccaggcgcagtggctcaagcctgtaatcctagcaatttgtgaggctgaggcaggtggattacctgaggtcaggagctcgagaccagcctggccaacatggcagaaccccatctctactaaaaatacaaaaaagaaaaaaaaattagccaggagtggtggtgggcgcctgtaatcctagttacttgggaggctgaggcaggagaatcgcttgaacccgggaagcagaaatttcagtgagctgagatcgcaccattgcactgcagcctgggcagcaagagagaaactccgtctcaaacaacaacaacaacaacaacaacaaccaccaccaccaccaccaccaccaccaccaccaccaccaccaccaccaccacctgggtggtgggcctggtgcagtggctcgtgctgataatcccagcactttgggaggctgagttgggaggattgcttcaggacaggtgtttgcgaccagggtgggcaacgtagtgaggcatcatctccacgaaaattaaaaaaaaaaaaaattagccacggtggcacatgcctgtggtcctagctacttggaagactgaaagactgaggtgggaggattgcttgaacccaggcattcaaggcttcaaagaactattatcacactactgcacagcctgggcaaaagagaagtaagaccttgtctcttcttcaacagagaagtaagaccttgtctcttcagaaagagatgaatgatgaatgttcatttacatgaaagtaatacttcaaaatataaacattgaaattattttgaagtgatactgtaccaagtaatttttttttggagacggagtcttgctctatcgcccaggctggagtgcagtggcgcgatctcggttcactgcaagctccgcctcccgggttcacgacattctcctcaagtagctgggactacaggcgcctgccaccacgcccggctaatttcttgtaccaagtaatgttttaaatagaaataaatcctttcactctatacttcccctcataaaagattattatatatgaatatatggataaacatactaacatacaaaatgcatattatatattcatgcatttacatttaatttatacataatgtggcatatattcctatacatataaataaacaattatacatatataaatagagctatattcacttataaatctgtgaacgtgtactattctttcgtaccatttaatactggtcctacctgaattttacctactgtttacaaaccaccaacaaaaagaacatacggcttttctagtgtcagtcaggtccacagaatcttagtgaaaaaaaaaaaaaagactttcttagtaaactcttttctctcctactcccataaatattatcattttccatcattctattcaagcttttcttctttttctttgttacaacatttttggtattacatgacttctcctacaatcatatttagagcttcagctaggactccttcctgaatcccagtctcagtttttgaataatgactattctctttacctatttttctgctgaccaataaaacacaatgcatctaaaactgtaattttcctttcctgcctgcttctccttccagattcttatttttggtaggctcagttttctcagggctaagtttatagcttctattctctcataattagaaacatgccaaaccctcttttcctcaatatctcacctgccacaatgtttcctgttgagttctcactgccataatcaaagttccggttaatacttcctttaattttggcaacggcattacattactgatggttttccctacctgttcatcacaattttgaagcatcaacccctaaaccggaactgggaaactagttttggacgttccatccctaaaccagaagtgggatgatccgcccttgaggagagatcttgatccatttccagcctaggagcttcaagcagatgcctgcttgaggatgttaatgcgggaaaggtaacaatcctgccttgctgtgctgcgatgtgaatcaagaaggctgcctgcaaatgatctcagttaacccagtaagaaaccgtcatggcaacatcgcgtgttagtgtgaacgtcagccagccctgttcagagctcgagggggaggtcctttcaggccaggctttcccctgacctcataatttacgctgtgaaaattgtacagaagtcggtctgttttcaccctgctgttggcaagaattgggggaagaaacctaatgccccctcgaaagtatgtatttttcagggcctggaatttgctgagtttttatttgtactctgcattttatgaaaaaaatgacaatgaggagcgccaaggagtacttggggacgtggagggcttgaacaatttattattattattattttttattttgagacgggatctcttgctgggttggagggctcaaatgatcctcccacttcagcctcctgagtagctgggactactggcatgtgccaccatacccggctaatttttctttatttttcattttctttctttctttttttttttttttggagaggtggggttttgccatgttgtccaggctggtcttgaacttctgagctccagtgatcagcctcagcttcctgaagtgctgggattacaggtgtgagccaccacacccggcctctgtgtcctacttctgttttttcacttctgaggtgaaataaacaaagtttgttctgttttgtaatagtaagaatggttacattaaataataataaggttggtgcaaaagtaattgcggtttttccgcaattacttttgcaccaatgtgtgtgtgttttccgctaggaaatgaaaaaaaggaactggggcccagtgtgctggaaactggagtgcttctagcactgtctccctttgctgcctcccgacaagctgtttgtgctgtggtcatgccaatcagctgggctttgaagaggaactggaggaccagctgtgaatgcactgtgagtgagcatctcccatcttgactgtacggaaggcagaggtctggcatcctttgtgtaaggacactgaagtttatacagattaagtataacctttgcccaaatccacctggctggaagaagcacattgcacagttgccaccacagtaagtctgggattgcttgagacagaagctttagcaattgctgcaataactggaggaagaaatagaaatccttagcagcttcatgtagagagtttcaagatggtgactcaggggatctgagctgtcaactccaatggtcccctctgatttttaacgaccttaaagtgctttcatttagtgccttgcttgtatataatctcacatattttgtaaatgcaaagcaagtaatcacattcaaggactattgaccaattacttttatttctttgaggttctgcacaattgagcatccctgtgttttggacacgtgaagctggtaggtgagtggtagtaagtatacaattccaaataaatgggctacattgctttctcatgcacagcacctaaactactattatttcacattgaacgccagtggaattattcataatcttctaggtggctcaaatagaataggcaaggactgagatttgcttgtaggatgaacaggaaaaaaagaaatcaagcataacttaaaagtaattacccgttttggtaatggtgccccaaatctttgatgaattgccatcacatatcaacgaaatgcactcaactgggacaatcctttttctagaaggaaacactaatgcagtttattaggacactactctaaaagacaaatgcgatgttcctgtgccatcaagttttgtcacaaggttgaaatgacctatcccagtgaaatttaagagccagaagattttcaaatatctatatggaaccagaggaagatagaatgaccttgccaggacttggacttgtttggcaaaagccctggttgaagccagacctaagctgtggaaactaatattttgtgcagacaggatagttccaaggaaactgcattttcgtgataccaacgttatcatccctgtgcctgaatgtgtctcccgggaaaatgcagcagatacctaggaaagttctgttggactaacctttgcaattcagaattgagtggtagcagtcctgtattcaaggtaaggccacttaacacagaagtaaaaaccaatctgtgtgttagttctggatttcccacctctgattagaaaaatttagggattaaactacttagaagcacataaagctgagaaggatgttattggtgcaacacagtgcatattctttctcaaaggcctatgtgtaaatttttttttttggtatgcagacaggtttttctacacaatttctttccaccttagatgtgctacatttctgtgcattagcttcagaacagtaatgttctccacatttgtctctcattttaatatccatggatttgctctcttatcaattctctcattttaaaaattaatttttaagtcaccaaaatgttaccgtattactgatgcctctgaagcctaatttcagtcaaaagttgttgttcacttttttgaactcataccattgagttcatatctgtacatctcttagttttcttaatactttctacttcttagaattgttatctgtatgttttatttcaccttggattctgatcttcttaaatttgaaaacatttaaaaaaaacgtattatatcacttgagtactcagcggagtgtttaaaaagattgcaactaccactgtggtttgagtgtgtgtgtgtatgtatgtgtttacattgcaggaatctcgaactcggagctataagacaaactaccagccatgaagatttgtatttattatctacagcatggtactcttgaaaacttgcttaagagtttccctgatatgacccagatctgtaatgttattttggggctctttaattgaaaaaatgcaaatgagcacatcaaacttaactttgtctactaagaaggaaccatacatttctctttattcgtttataacttatttaagtgagaagtgaggataataccacttgttagtttaattacataataaatataaatatcttttaactgctataagtaaacatctttaaagatattaaaaaaggtaacgaaaaaatattgacactatgtacagttagaagatgagcatcaaaactgagtactgggggaacctcaaacatgtaacctaatctgtctaatatcaaaattcagatatggtgcaaagtttgagaagccacgcaatttagggacagatatttttggaatctgctgggccatctacttatcttcactgccttgtacatatacatatatatgtagagaaataacatttttaactgtttgtcattggaacacaatgaatctctattatttacctctaatcattgctcatgaaggcagataaagtattagttgtacaaatgttattacatttcttcttgggaagatagtgtgtgggaacttgttagttttcatcaactcaagaaaaatgctcatttattaaggaattgatgctgatatgaaatgacaagtgaattattacactgtagagtgctttgcttagaatgcatatgactgtgcatgtaatcacaaattcctccggtttctggagtgttacttggactacatgcaacaaaccaccaaacattagtgatctcagttcttttccttcaactcttcagggttgcacttcctcagtgcaaattattctgtggccctaagtagaggtgggaaagaagaaaaacaaaattctacccatctaaatgaaagtggcaacgttaatctaccccaaggcactaaactgtaacattttatttaatcatttatattaaaatcaacagaatacaacagtaaattacattccccaaatcataagggcttatattcaacacttaacctcacgtcagggaaaacatgaaagaagtgttgcagtcaactcttcatctgtctgacatgtgccactgtatgtatctgacttgctttccttgcttttttaaatgcttgtccaatttgtttttttactttgttttgtggaaggctgcatatgccctcagggcagtattcggtactttctgatgagcacaaagaatgttgctgacatagcaaaatcttcagaaagccagaaaaatgaaaagtttttccgaaacatcattataattacattgggtacaaaagtctcagatactggtaagagcacatgtaattgttttgctgtttcatatttttttacagtcccaagttgtatgttcatttatagtataggtggtaatgaaatagaaaatatattacatatataaggagagagagagagactaagtatcctacaatgatgcccagcaagatttacattaagtttcactttaagcttcaacataaatagaaaatgtgtggcattgacaggattgagatttcctgccactgattgcagaaataataaaacttgagatgaggattgggaagagacagtaaactcttccaatattaaagctaattgagacaagttatgttgtaacttatttaccaacttctcttttacagtatcattctcttaaatatatatataaatttttttctgtgagctgaaaaagggcctggttagaatagaatcagtagtagcaaacattgaactaactatgtcagcaagagtacaggaattaactcgttctgagaaaagttataactgtgaacactgttttgatttgtcgtggggaagagaagagcgacaatgatgatgaaaataacttaagtctttcaaagggctataaaatatactttgttaaatcctccataaaactcatgaggtaggtaagaatatattcgtgattattcttacactataaatacaaactgaactaagatagttttagtggtgtgccccagtataatagatagcaagtatgctgtcatacctatgtatgataaatggcaattcggtttaaacacaggcctttgtaaatatatctctgatgttgtatgcatcctagtctacacagagtttatcagagagataaacattaggtgcttcaaagtcaagttaaaaattggttaagcaattaatattgaagaacactgggaatcatgtttccaccttaatgttaagacataatacatgctgttttggttactgtagcctagtagtatagtttgaagtcaggtagcgtgatgcctccagccttgttcttttggcttaggatagacttggcaatgtgggcttttttttggttccatatgaactttaaagtagttttttccaattctgtgaagaaagtcattagtagcttgatggggatggcattgaatctataaattaccttgggcagtatggccattttcatgatactgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgttggtctgttattgttgtataagaatgcttgtgatttttgcacattgattttgtatcctgagacttcgctgaagttgcctatcagcttaaggagattttgggctgagacgatggggttttctagatatacaatcatgtcatctgcaaacagggacaatttgacttcctcttttcttcattgaataccctttatctccttctcctgcctgactgccctgaccagaacttccaacactatgttgaataggagtgttgagggagggcatccctgtcttgtgccagttttcaaagagaatgcttccagtttttgcccattcaatatgatactggctatgggtttgtcatagatagctcttatacagtaaccaaaacagcatggtactggtaccaaaacagagatatagaccaatggaacagaacagagctctcagaaataatgctgcatatctgcaactatctgatctttgacaaacctgacaaaaacaagagatggggaaaggattccctatttaataaatggtgctgggaaaactggctagccatatgtagaaagctgaaactggatcccttccttacactttacacaaacattaattcaagatggattaaagacttaaatgttatacctaaaaccataaaaaccctagaagaaaacctaggcaataccatccaggacataggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacagaatggaagaaaatttttgcaatctgctcatctgacaaaggggctaatatccagaatctacaatgaactcaaacaaattcacaagaaaaaaacaaacaaccccatcaaaaagtgggcagaggatatgaacagacacttctcaaaagaagacatttatgcagccaaaagacacatgaaaaaatgctcatcatcactggccatgagagaaatgcaaatcaaaaccacaatgagataccatctcacaccagttagaatggcactcattaaaaagtcaggaaacaacaggtgctggagaggatgtggagaaacaggaacacttttacactgttggttggactgtaaactagttcaaccattgtggaagtcagtgtggcgattcctcagggacctagaactagaaataccatttgacccagccatctcattactgggtatatacccaaaggattataaaccatgctgctataaagacacatgcacacgtatgtttattgcggcactattcacaatagcaaagacttggaaccaacacaaatgtccaacaaagatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttcttactcataggtgggaattgaacaatgagaacacatggacacagtaaggggaacatcacacaccagggcctgctgtggggtggggggaggggggagggatagcattaggagatatacctaatgttaaatgaagaattaatgtgtgtagcacaccaacatggcacatgtatacatatgtaacaaacctgcacgttgtgcacatgtaccctaaaacttagagtataataataataaaaaagacataatacataagatgattatttttccttaaaggatggtataagcatttatgtacaaccactagtatagtataaaaggcaataacatattgtctcaataatattgccacacatttttactgtacattttcatacagtaatagatcaggtaaactaacttgaattcagtactaccaaataacaaatttgggtggatttaatgcatatattaatatatttttacattgaagtaaaatgctcagattacgaatcattttcctgtttaagtgttgtttttcttaagcttgttattaaattctaaaaataataagaattttgttattgataaatcattaccattcatttattatttcactcaaacatttattgagtttatactaggtaccagatacctgtgctatgcacaatgactgcaatttaatatgcagcttaactagaacagaaaaatactacagaggaaatgcagtaaaaacacatgttgtggttagaaatgcttttaatactttcctgatagttgttatgaagaatttttaaaaaacattttaaatggttactcagtctgtattgcccaagacattaagtattgccttagttctatctccacttactgaagccctactatgcacatggcattgtgctagaaagaaaagtaaagattaatttaaagtccatgttctgtctgtgcctggtggctcaccgtctgtaatttcagcgctttgggaggctgaggtgggaggatcgcttgaggcccggagcttgacaccagcctgggcaacgtagtgagaacttgtctctatgaaaaatgataaaaaataattgctaggcatgctggtgcacagctgtagtcccagatacttgagaggctaagacagaggatcacttgagcccaacagttcgaggttgagccatgattgtgccatgcacttcagcctgagtgacagagtgagaccctgtctctaaaataaaataagtccctgttcttgcactaatgtctagtgcaaggcaaaaggaaggtaaatgtgcccaaaagtagatccataaattgttagaggcatgatgttacaaaaatgcacaggttataatagaaacataaaatagggaaataagagacttttctacttgagagttggctgttttcagagaatattacatagaggagatgaagacagacagggagtaagataagagtaggaaagacccgagggtaagagtacagcaaaaaaacaaagtgacatacagagtgtaacatttctatattataaagttgttgatttttcctgttttcttaaaatctcaccaccatctgagcagaaatagtttaagttaatacattatagagctcatgataaacaaaatgaacagcctggttccagacttctattctgtaataattttattaaatgagaagataataagaaaataccttgaaatttttgaagggaaatgttatgttattgttccataattgtagttcacaaaagttctctttattttgcagaggcaaagtcaatttttttttctggtatgtaaggtcttcagaaataaagtattgatttatttttctctttagaaaataattaaaatttccaccaagtcgttttagagatgaattaagaaccaagaatggagagactatggtgaaaagtgactgcagttttttttcttacttaattttgattccaaattccagaaaccagtaggatttaggtatcctcatgtttttaaagccaagtggtgaagctagattttatattaagtactatttaagactttatattaagcttggatcctgttttgtaacttcaaattttgtagaatcacgaaatatattatatatattatataaatacttacgtaatcatatgtttatattttacaaatatttattattatataaatataataaaattgcatccaagcttcaaatagaacacataatactgttgtttgtagccacttgaagcagtaactagctttttttccattcatgaacttactgaaattgactataatatttgcatagtttggagtctacaagaataattaccaagtgtttgttcttgtttatcccatttagaaagttagagctgagttgggcaatttaaaggtcacttccatgtagagaaacttgagaaatgatttttttctttatctttaaaattcttcctgaacaagcataatatgtatcaaaaaacctccacatattatcttgcatctaagacctctaaatgttcttatatgtttaatatgtaaaactttaactatgaaaaaaatgtatacagagaaagattaaagaactacaatgacatattaatagtgatagtatgcattttgtacaattatggatgttacttttttctttatacctttctatattttgtactttttaaaatatgcatatacccattaaccatcccttctttccagcttcaggtaatcatcattctactctgtatatgcgtaaataacgttaaactggaatacagaatagaatgatggttctacttttgactcttccttttgtcttttctcaattaatacatttttttttctatttcaaaaatatgcatatagcttatatttggaacaatgcatttgaaaaactcctaaaattctgtatatattatcaaaattatgcaaaaaatatagagcaaaaattctggaagggactagttctaaagttaaaaattgtcttctaagcctaacagggttttgtttctttccctttctattttgtaaaattactgctcttacattgattttatagaagatataattttcatttatataaagactcttaaagttgcactctaacatctgaattgacaaatcaggccacaaaactgtacatcatagtgcatgaatgacaagtaatttcaggttaactcaaggtggtaattcaagtttaagaagaaagatgtcattggcgataattcagataaaagaagaaaaatgtcattaactatcctacagcctactcccaatgagattgaagcagtcatttccatagtcaaatggtcaaatgtgaagaataagtatctgtgttctagggacatttatagtaatggtataattaacattttaaaaatgcattttaaagtgtcaattccctttattcgagttatcacattttaaaaatttctaatacccgaactagttttttttttctattttcagcctcttaagtttaggattaaaccttgttatattaacaactatatgacaatcttgattcatttggcttaacttcggatgaaaccagaattcaaatgtcttttcctcttggtcacagattccttaaagtaaattatcaagtgatttttataaataaataactgaatttaaaaatagaaataacctagatttattaccaggtccctaaatataatttttataccaatatttcagcttatctttttttcaattccccccatggtataaattacttattgattaggaaataagttatggtttgagagcataataaaaatctgcaatgaaaaactctttttagaaagaaattaataatttcaacagtgaaaatcaattttcctatgttcaatcttgtaatctattttgcattatttcccttgtgtaatcgaaacatcattgattcatggcattatgtagataataaactaaaatgaaagaattacataaagtatatttctctatggctattccctagcagtctcatactaaaatacttaaatttctatattcaataactaaagatgtcatgagagaattaaacagttttaaaaatttatccattgttgaaaagctcataaaacaatattttttatatgttgtttcaaatatttataacataaagatagggaaaataggctattaataaaagctatgaagaaacactaaaattctaaattctaggggaacttattttatgaaaggctgtgggactgtctacatgcattatctattttaatcctcctaggactccaattactagatattatcatatctatttatttattatggaaaaaatgaagctttcagggatgtttaatgaacttttccaggatttcataactattgggacgaggtgtatctgactccccagactgtggtgtaagacattatgctatgttgtctctcttcaaacagtgaaagtaattaatcatcaactcaatattaatgcttagggttcctgatatatacatacatatatgtttttaaactgctaaatggttcaatattagtgaatgtacaatgatacattatgattaatacttataatactatagatacatcctgcagttatgatggtgtatttgtgtcacctgtcctgaaatttcatgttcttgctaacaccgaaatttttaaaaatactgtggtaacaaagtaagtgtccaagtcctattcataaggagtggggatataaaataagaacaattttacttttatttttaattacataagcaatgcaagaatgtagaaaaaatagaagcagttgaatgttctcctctactcccatcactgtaattcctactactgattaccattgctgctatagtttggttttttaggaccttttctctgcatgtgcatgcacatgcacacacacacagacacacacacaaatactaaacacacacacacctatttaaaaataacacatacgttgaaccatatcatgtttttgtttctttcactatatcttgaaaatctttccatatcagcacaaatagattcactttattttttcaaattgctgaatagtctagttgaaacatgtttttatttaacccactcccttagttccaaatactatcttacaaaaatgatgcaattaaaattcatataagatatctttgtgcctaattttttgatataaatatattagtaaaattgatgggtcaaaaagtagtctcatttatgagagatacttccagctccccttagtcttgtaatatattcttgtgtattgactgtaacattacaagtagttcagtgtttattttctgcatttcaaatagatcttcccccagtaaatttaagcagatctgagatattgctgttgacagcttagttaaatgagctttctcagctcttccaatctgtgtgtgtataatttctctagagtccagaagattactaaaagggatccttttcaattaaagtagcaacagtgaagcatttgtgtatcgtaccatttactaagtggaaggtaatcctcatagaaaatacacatgttgcaatctatttggatttcatttctaaagtcattattaactagttctcagtatactataagtaggtccacattctaaaaggaaaaatagtgacaacacataactacaatgaatcattattaggaaatcttcaagaaataacgaatttttcactatcacagtgtacctcacttcataagcaaactgaacatacagtgtcataatagaagaggaaagggctacctggagacctctgggaagcacattcatgggtattttcctggctgttggctcttctgataactaaacttttgctgtattccatgttttctcaaagacaatggctgcgactaagttaaaatatcctagcataaagcattatttaaagataatttaaaatttttatattttaaagtaattttgttacatttttattttaaaaattataattttctgttttattggctactctaatattgaatgtttaattacttagatcaaatgttatagtatgatgtactatatttctggcccagagaacagaatagaaaaaatttattttaaaatacacatggtttttcatgaaattcatatgatgaaaaacattaacataaaatataggtcaatatacactacaaaattataactattttatctgattaagaattgtggtccagttaaaatagtttggttaatgagaaattatccattttaaagtcacattttggagtttatgtgaatacatgtaatgctgaaatatgttaagcataatttaatatgtcatggtttatcaaatagttcaaaagctttcaatgccccatggccctcattatagcttttactataatgttccagagatctaactaatttctaaagttcacttcactttgctaaattcatcattgaaataacagtgatgatccatcatttcattttttctaaaaaatatattttatatatacagtaattatttatcatcagtataaaatattatagatcataatagcttctcaccaacataatattgtattttatacattttccattgacctaagttgtatacattctccaggctttgaaaatcaagtgtatctagtcaagaaagtatcaaacacatgctgttaaatcttccatcaactaccttttctaaataataccttgcatcttctggatccctttgccacactcctctgcacagtctttcttacaacaaatctgaccatgtccttcccaagcatgagacgttccaagattccatctgctgatggaaaaaagttcaaaatctttttcattattattaaaagctcctattaccttctcttgccctagtaattgacagcattcccaacaccatgccctttgtctgctgacatacgttgagctcctcatcatggcagggcaagtgatgctgtcactatgaagtattgctgatttctctcctataggtaagaagtgatcaacacttttttggggtctggtgtctaacttgtagtttgtccatcacatcacttttaacattttcttactcttatttctttacacaacttttttttccccagataaactctgggctcattgaaggcaagaaattaggcccaggtgtacctcagaaatgttccctaacagttttgattaaaattttaattgataaatttaccatttgagaacacagacaaagccatctctttaattaaaatttgagaaagctttagtagaacatcaagaaaattgtttctggtaataatacactatggtgctattctgtcagctatgttgtgtggaaaaatcaggttaggttttgatcctggttcctagagattataaagattgggggtaggattaccttattaaaacaaaagcactgagaaagtaaataagtgggggaaatccatattatgactaagaaatgatataagatatctcattacatattccaattatctatattttcactgtacatgtaattattgtgcttactattttattgttttatcaaactggagtagtatgcactgtcttctctattttctaattattgtttacagtatttattatcgagatggtcttttgactgacatttataaaagattgaaatgattaaagacaaaatatagtaaaatgcctgatgctatttaatggacaatgttataagcagtaaagcctgatgatctccgatattatatacataaccatcatatttagcttttagtgtgtgccaggctctgtgtaagaagtttacatctttctaattttcatagaaaacttgttatatgtcaatatcagatcaaaaaagacagagtcaaactctagagtgagtcatgggaaagaaaggagtactaaacatcagtgtgcagccaatttgagtgtaaggctggatctactctcacgagaaaaactgtaacagaaaggttgctgataaaatactgaccttactatgctttttaaacagtacatttaaatacatacaaacttatgtaaactggttggacagagatctaacatgctaaaaaccagcagagtaaaatctttttacagtatgagaatgagaatacaaacttctgtttcagcttctttccttagtcacaatttcctgccttaaagaaaatgtcagacggctgggttcccccaaaaaagtagagaggagaacctgcttaaatatttcttgaccattataaattaatttattattttctctattttcattttcttcaacaaggagggagctactcttctaatttaatactgttgcccatgatattagtgatgacactttatttatacctaatgaggaactttacaggatagatgtattgcaattagatcctgtctcagagttttctctttattcgttgatgaatgtgtgtaattcaagaacattaaaaacaactgtgaaagtataattattacagaggagaaagtgtctggggattaattttattacatataaccatatttggagggacagtatagaaacagttatttaataataaacattaagtttcttaacaacaagtagcaattgacttaggcaaatgcctattaaaaagagcacattaaaaatcaagtaaaaattacatcaaacacattttttttcctgtgttgggaatatcgtatttcatgacaaagacttataaatgaaggaagaaaagagatggcaataggtgtgggtcgtgccattttacaagagagacacaggagtctcagcgattgaaataattttcccatgtagatacaactcttaagtgacagaataaaatttgtacttaggtttgtacatttggaatctcatgccaactggttaaaaaaatttatgtgaacaatttgtatgatgtttatgtgtatagaatgacactggagttgaaatcagtatgattgtggaattgaaaagacgacagtatatgccagaaatcttcactttatagcctaaatatgagatgatgcctatactatggcttaatgttagtgagtatgactacatgtacagagttctacatgagataaaacacattaaatgaaaaagttcactggtacacttgtatcaaagaccaacaataaaaaacactgaaaaggtttactagtatcaagcacttgttgagaaatctattaggtgtaaaacattggattgggactttttaaaaggaggttaaagaggcaagactgaaatttgattagtatatatatttatgcattgttcccaatggaatattacttatattctaatccagaaggaattgtttatcatttactcagtagttcaaagcacattttattattaaattatgcaaaatgggctaaaactgataatcacagaatattcaagccagaaaaaaatgtaaagattattagttcaattacaactttatgcagaagaaaaattcaatgccaaaataatccaagtgaccgatttaatttgttattgataggacaaagactagctgaaggtttcttgaagtttgatgtagtatatctgaaagaatgcaaaattgtgcttagagtctacggtgatagtgtttcatgtaaccattacatttagtcaccaacaaaagcataaaacacatataatcaaatatgggagtagtagcatgttggtgccacacttaagattgacattctgtctcaaactgaatctatcatagtcagtggttctcttcacattataaataattttttttttcttttgagtacaaaatgtagtcaacttgggtttcaaaattatgtatgaaatacatgcatcttaagcactagaatcacagtgtggtaagaggttaagtaggaactaataataactgagtgaatagtagattcacatcccacatttaattttcagggtcacagtgggataaaccaagtgaaacgatggccaaaatggtctgcatagaaatttatataaaacattatttccgtctctgctgcattctttttctctggttttgctgaccttttatagtggtatttatttcagttaaatttgcttacattgttcttacactttaatgcatgagagtaaaatattacataaatatttaaagagtcagactagattatgaatatgtatgaatatattaacatcaataacaaagcaatatatcagttggaaaaagacatgaaaataggaattttattacaacacctgcaatgttcaaatgatgtaaggttcacaaaaatagcaaccagaaggaaaatcaacgttctagcagcattgatgtggtctacacagtatgcaaaaatggagcaatttcagataagtttctggatttctcttgaaatctttgcaattgtgtttttactttattcaattttatttatttatatatttacttgttaacttttatcttaagttcaggggtacatatgcaagtttgtcttataggtaaattgtgtgtctctggggtttagtgtagagattatttcattacccaggtaatacgcatagtacctgataggtagttttttgatcctcatctttctcttaccctacacctcaagtgggccctagtgtctgttgttctcttatctgtgtccatatgtgctaaatgcttagctcccacttacaagtgagaacaggtagtatttggttttctgctcttgtgttagttcacttaggataatggcctccatctccatctgtgttgctgcaaaggacataaactcgttgttccttatggctgtgtaagatcctgtggtatatatctaccacgttttctttatgtattctaccactgatggacatttagatttattccatgtctttccttttgagaacagtgccacaatgaatatatgtgtgtctttatggtagaatgatttattttcctttgagtatataccaaataataggattgctgggttgaacggtagaattaccattttgagatatttgagaaatcgcaacactgctttccacagtggctgaactaatttacattcctaccaacagtatacaagcgttcccttttctctgcaaccttgccagcatctgtcattttttgactttttaataatagccattacgactggtgtgagttggtatctcattgtgaggttgatttgcatttctccaattattagtaatgttgagcattttttcatatgtttgttggccatgtgtatgtcttcttttgaaaagtgtctgtttgtgtcctttgcccactacataatggggttgtttgttttttgcttattaatttgtttaaattccttatagattctggatattagacttttgctagaggcatagtatgcaaacattttctaccattttttggttgtttgtttaactctgttgatagtttctttcactgcgcagaagcttttcagtttaattaggtcccatttgtcaatttttgtttttgttgcaattatttttagcatctttgtcatgaaatctttgccaggtcctatgtccagaatggtatttcctaggttatcttctatagtttatatcattttaggtttaacatttaagtctttaaatcatcttgagttgatttttgtatatggtgtaaggaaagtgtctatatttagtttttgaaatatggctagctagttatcccagaaccatttgttgaatagggagtcctttctccatagcttgtttttgtagacttttttcaaggtcagatggttttagctgtgcagcattatttctgtgatctctattctgttccttggtctatgtgtctgttttgtagcagaaccatgctgctttggttgctctatccctataagtatagttttaagttgggtaatgtgatgcctccatctttgttctttttgcttaggatggccttagctattcaagctcttttttatttcatatgacttttcagatagttttccccccttagttttgtaaagaatgccatttgtagtttaatacttgaatctttagattgctttgggcagtatggctattttaaaatattgattctttctattaatgagcatggaatgtttttccatttgtttatattgtctttgatttcttagagcagtattttatctctcactgtggaagtatttcacctccctagttagctgtatttctaggtaattttttttctttttgtggctattgtaaatgggattgcattcgtgatttggctctcagcttggatgttctatagaaatgctactaattttggtacatttgttttgtatcctgaaactttgctgaagttgtttatcagatcaaagagttttggggaagagactatggggttttctaggtataaaatcatattctctgcaaaaacggatcgtttgacttcctctctttcaattactatgcctttatttctttcttttgcctgattactctggctaagacttccagtaccatgttgaataggagtggtgaaagagggtatccttttcttgctccagttcccaaaagcttccagctcttgccctttcattatgatgttggctgtgggcttttattttattttttgatggctcttatttttttaatatattccttcaatacgtagtttgttgaaggtttttaatatgaaggaatactgaattttattgaatgcttttttctgtatctgatgaggtgatcatgtgtttttgtttttagttctgtttatgtgacaaatcacatttactgatttgcatatgttgaaccagccttgcatcccagggacgaatcctgattgataatgctggattagctttagacgtgctgttggattcagtttgctagtattttgatgtggatttttgcatctgtgtttaccaaggatattggcatgaagttttctgttttcattgtgtctctgccaggtttcagtatcaggatgatgctagcctcctagaatgagttaggaaggagtcccttctcttcaaatttttggaatagtttcagaaggaatagtacccactcttctttatacattggtagaatttggctgtgaatccatctagtcatgggctttttctgatttataggctttttattactgatcttatattggaagtcattggtctccagggattcactttctttctggttcaatttgggaggttatatctctcagaattgaccaattttttttccagattttctaccttgtgtgcatagaaatgtgcatagtagtctctgagggttttttgttgttgttttttttaaatttttttttattatactttaagttctggagtacatgtgcagaaagtgcaggttcattgaataggtatacatgtgccataggggtttgctgaacccatcaacctgtcatctacattagatatttctcctaatgctatccctaccctagcccccgacaccccaacaggttccggtgtgtgatgttcccctccctgtgtccatgtgttctcattgttcaactcccacttatgtgtgagaacatgcagtgtatggttttctgtttttgtgttagtttgctgagaatgatggtttccagcttcatccatgtacctgcaaagaacatgaactcatccttttttatggctgcatagtattccatagtgtatatgtgacacattttcttatctagtctatcactgatgggcatttgagttggttccaagtctttgctattgcgaacagtcccacaataaacatacgtgtgcatgtgtctttatagtacagtgatttctaaccctttgggtacatacccagtaatgggattgctgggtcatatagtatttctagttctagataaattgccaccgtctcttccacaatggttgaactaatttacactcctaccagcagtgtaaaagcatttctatttttccacaacctctccagcatctgttgtttcctaactttttaatgatcaccattcttactagcatgaaacagcatcttggtatctcattgtggttttgctttgcatttctctaatgaccactgatgatgaactttttttcatgtgtttgttggctgcataaatgtcttcttttgagaagtgtctgttcatatccttcacgcactttttgatggggttgtttttttcttgtaaatttgttgaagttatttctagattctggatattagccctttgtcagatgaatagattgcaaacattttctcccattctttaggttgcttgttcactatggtgatagtttcttttgctgtgcagaagctcttcagtttcattagatcctatttgtcaattttggcttttgtggccatttcttttggtgttttagtcatgaagtttttgtccatgccaaagtcctgaatggtattgcctaggttgtcttctagggtttttattgttttaagtcttatatttaaatctttagtccatcttgggttaatttttatataaggtgtaaggagggaaccccatttcagctttgtgcatatggctagccagttttcccaacaccatttattaaatagggaatcctttccccattgcttgtttttgtcaggtttgttaaagataagatggttgtagatgtgtggtgttatttctaaggcctctgttctcttccattggtctatatatctttttggtaccagtaccatgctgtttttattactgtagccttgtagtatagtttgaagtcaggtagtgtgatgcctccagctttgttcttttggtttaaaattgtcttggatatgcagactcttttttggttccatatgaaatttgaagtagttttttccaattctgtgatgaaagtcaatggtcgcttgctggggatagcatcgaatctataaattactttaagcagtgtggccattttcacgaaattgattcttcctctccagccccatgggctgagacgatggggttttctaaatatacaatcatgtcatctgcaaacagagacactttgacttcctcttttcttaattgaatagcctttatttatttctctttcttgattgccctggccagaacttccaatattatgttgaataggagtggtgagagagggcgtccgtgtcttgtgctggttttcaaaaggaatgcttccagtttttgcccattcagtatgatattagctgaatcttattattttgagatacattccatcaatacctagtttattgggagttttcagcatgaaggactgttgagttttgatgaaggcttttcctcatctattgagataatcttgtggtttttgttattggttctgtttatgtgatggattacatttattgatttgagtattttgaaacagccttgcaaccccagcacgaagccaacttgactgtggtggataagctttttgatgtgctgctggattcggtttccagtattttattgatttttgcatcaatgttcatcagggatattggcctggaattgtctttatttgttgtgtctctgccaggttttggaattaggatgaccctggcctcataaaatgagttagggaggtgtccccctttttctattgtttggaatagtttcagaaggaatgataccagctcctctttgtacctctggtagaatttgcctgtgaatctgtctggtcctggactttttttggttggtaggctattactgcctcaatttcagaacttgttattggtctattcaaggattcaacttcttcctggtttagtattgggagggtgtatgtgtccaggaacttatccatttcttctagattttctagtttatttgcgtagaagtgtttatagtattttctaatggtaatttgtatttctgtgagatcagtggtgatatcccctcgatcattttttattgcatctatttgattcttctctcttttcttctttattagtctggctagcagtctatcgatttcgttgatcttttcaaaaatccagctcctggattcattgattttttgaagagtttttcgtgtttctatctccttcagttctgctctaatcttagttactttttgccttctgctagcttttgaatttgtttgctcctgcttctctagttcttttaaatgtgatgttagggtgtcaattttagatatttcctgctttctcttgtgggcatttactgctataaatttccctctacacactgctttaaatgtgtcccagagattctggtatgttgtgtctttgttctcactgatttcaaagaacatctttatttctgccttcatttcattatttacgcagtagtcattcaggagcaggttgtttagtttccatgtagttgtgcagttttgagtgagtttcttaatcctgagttcttatttgattgcgctgtggtctgagagagtgtttgttattatttccattcttttgcatttgctgaggagtgttttacttccaattatttggtcaattttagaatatgtgggatgtggtgctgagaagaatgtatgttctgttgatttggggtggagagttctgtcgatgtatattatatatgcttggtccagagaggatttcaagccctggatatccttgtgaattttctgtattgttgatctgtctaatattgtcagtggcgtgttaaagtctcccactattattgtgtgggagtctaagcgttggggtgatcagacccaacaccaggtcatgggggtgacgaagtccagtggagtcaaaggaatgggaaatgacagtttgagagagaatgtgggtccagggggccaatgctactatggaggctgtgaaggccctgagctctggaagcccacactttttattggtgatcaaacaaagaaataggtggtgagaatgtgggggtcgaaagggcaagtgcatgatctacaggtgtgatggtttagcatttcctttgaagcatatgggacatattctgctagttgagataatggggagcatgttcttctagtttaagctagaagcaaggagccagcaagtctagactcattccagatgccacgagcggtttatgccctgagccctggacattatgtcagacatgcaagccctgtctcagcttttttcccaacatttagctttttcccaacactaagtctctttgtaggtctctaagaacttgtttcatgaatctgtgtgctcctgtattgggtgcatatatatttaggatagttagctcttcctgttgcattgatccctttaccattatgtaatgcccttctttgtctcttttgatctttattgtttcaacccttgctttatttatttatttatttatttatttttttgctttccatttgcttggtaaatattcctccatccctttattttgagcttatatgtgtctttgcatgtgagataggtctcctgaatacagcacaccgatgggtcttgactctatccaatttgcaaggctttatcttttaattgtggcatttagcccatttacatttaaggttaatattgttatgtgagtttgatcctgcctttataatgctagctgggtattttgcccgttagttgatacagtttcttcatagtgttgatggtctttaaaatttggcatgtttttgcagtggctggtaccagttgatcctttccatatttaatgcttccttcaggagctcttgtaaggcaggcctggtggtgagaaaatctctcaggatttgcttgtctgcaaaaggttttttttctccttcgcttatgaagcttagtttgggaggatataaaattctgtgttgaacattcttttctttaagaatgttgaatattggccccactctcttctgtcttgtagggtttcactgttagtctgatgggcttccctttgtgggtaacccaacctttctctctggctgcccttaatatttttttccttcatttcaaccttggtgaatctgatgattatgtgtcttggggttgctcttttcgaggagtatctttgtgatgttctctctgtttcctgaatttgaattttggcctgccttgctaggttggggaagttctcctggataatatcctgaagagtgttttccaactgggttccattctcctcatcactttcaggtacacctatcaaatgtagatttggtcttttcacatagtcccatatttcttggaggctttgtttgtttctttttactcttttttctctaatcttgtcttctcactttatttctttgagttgaccttcaatatctgatatcctttcttccacttgatggattcggctattgatacttttgtatgcttcatgaagttctcgtgctgtgttttttcagctccatcaggtcttttatgtttttccctaaactggttattctagttaacaattcatctaaccttttttcaaggctcttagcttccttgcagttggttagaacacgctcctttagctcagaggagtttgttgttactcaccttctgaagcctacttctgttaatttgtcaaactcattctccatccaattttgttcccttgctagcagggagttgtgatcctttgaaggaaaagaggggttctggtttttgtaattgtcagcctttttgcattggtttttcgctttctttgtggatttatctacctttgatctttgaagtcagtgactttaatttgggttctctgagtggatgtcctttttgttgatgttgatactattcctttctgtttgttagttttccttctcacagtcacatccttctgctgcagatctgctggagtttgctggaagtccactgcagaccctgtttgcctgggtaccaccggcagatgctgcagaacaaccaagattgctgcctattccttcctctagaagctttgtcccagaggggcacctgccagatgccagcccattacagagctctcctgtatgaggtgtctgtcagcccctactgggaagagtctcccagtcaggattcacaggggtcagggacccacttgaggtggcagtgtatcccttatcagagctcaaacactgtgctgggagatctgctgctctcttcagagctgccaggcagggaagtttaagtctgctgaagctgtgcacccaatcacctcttctcccaggtgctctgtcccagggaggtggggcttttatctgtaagtccctgactggggctgctgcctttttttcagagatgccctgcccagagaggagggaatctggagaggcagtctggctgcagtggccttgctgagctgtggtgggctctgcccagttcgaacttccccatggctctgtttgcactgtgagtgtaaaactgcctacttaagcctcagcaatggcggaagcccctctcctcaccaagcttgagtgtcccaggtagagttcagtcccaagccagaccacttggctccctggcttcagccccctttccagggcagtgaatgattctgtctcactagcattctgggcaccactggggtatggagaaaaaacaaacaaacaaacaaacaaaaaaaaaactcctgcagctagctcagtgtccgcccaaactgctgctgagttttgtgctgtaatccgaggatcctggtggtgtgggcactggagtgaatctcctggtctgtgtgttgcgaaaaccatgggaaagcacagtatctgggccggagtgcatggtacagtcctaatggcttcccttggctaggagagggagttccccgagcccttgtgcttcccaggtgaggcgacgccccaccctgcttcaactcaccctccttgggctgcatccactgtccaaccagtctcaatgagatgaatcgggtaccttagttggaaatgctgacatcacccaccttctgcattaatctggctggttgctgcagaccggagcttttcttattcagccatcttgcccatttttttttttcctgttagctcagtggtaatgtcccatttaccatttctgattgtgtttatttggatagtctttcttttttattagtgtagctacttgtttgtccatcttatttattctctcaaaaaacaaattcctaattttgttgatttttttttatggtttgtgtgtccccagttccttcagttctgattttggttattttttgtcttctgctagctttgaagttgagatactttgctgttgtttctgcagttcccctaggtctgatgttatgttattaattttaaatctttctaacttttgatgtggctgtttagcaccataagtttccctcttaacattacttttgctttgtcccagagattctggtatgttgtatctttgttctcataagtttcaaagaatttattgatttctgccttaatctcatcgtttacccacaagtcattcaggattaggttgtttaatttccatgtaattacatggttttgagttatcttcttagtattgacttaaattcttatagtgctgtggtctgattctgtggttagtgtgattttgcttttttagattttcctgataattgttttatggacaattatgcagtcaatttcagagtatacccgtgtgcacgtgaaaagaatgtatattctgttgtttttgggtggagagttctgtaggtgtctattaggtccatttggttgagttcaggtcctgaatatcttcgttagttttctgcttcgatgatctccctaatgtgctctgtggggcgttgaaccctcctcctgttattgtgtagctatctcactctcttcataggtctcaaagcacttgctttatgaatctgagtgtgcctgtgttgggtgtatatatattcaggataattaggtcttctgttgaattgattcctctaccattatgtaatacgcttctttgtcttttttgaactttgttggtttaaagtctgttttgtctggaattaaaatagcaatgcctgcttttttgttttccatttccttggcagatttttctccatccattaactttaatcctatggatgacactgtatgagagatgagtttcttgaagacagcatatcattgggtcttgcttctttatccaacctgccactttgtgccttttaattcaggcctttagcctggttacattcaaggttaatactgatatgtgtggatttgatcctgtcattgtgttgttagctcgtttttatacaaacttgtttgtgtagttgctttatagtgtcaatggtttctgtagttaaatgcgtttttgttgtatctggttgcagtctttcctatccatatttggcactaccttcaggacctcttgtacaacaggtctgatgcaaggaattcccatagcatttgcttgtctgaaaagaatcttacatgtcctttgcttatgaagattagtttggctagatacaaaattctctgttggaatttcattaagaatgctgaatgggagttcgaggtgggcagatcacagggtcaggagattgagaccatcctggctaacacggtgaaaccccatctctactaaaaaaaatacaaaaaattagctgggcgtggtggcaggcacctgtagtcccagctactcgggaggctgaggcaggagaatggtgtgaatccagaaggcagagcttgcagtgagccaagatcatgccactgcactccagcctgggcaacagagcaagactctgtctcaaaaaaaaaaaaaaaaaaaaagaatgctgaatataggcccccaatattttctggcttatagggtttctgtcaaaaagtctgctggtagcctgatggtgttcacattgcaagtgaccttctctccagctgcatttaacctttcttctttcatttcgatcttagagaatctgatgactatgagtcttggggatggtcatcttatgtagtatctcacaagggttctctgcattttctgaatttgaatattgtgtcctctctagtgaagttggggaaattttcatgggtgataccatctgtattagggttcctagagagacagaactaatatgatagatgtatatataaaagggagtttattaaggagttttgacttaacacagtcacaaggtgaagtcccacaataggtcgtctgcaagctgaggagcaagtcagtccaagtccaaaacctcaaaagtaggaaaactaacagtgcagccttcagtctgtgacagaaggcctgatagcccctggcaaaccactggtgtaggcccaagagtctaaaagctgaagaacttggagtccaatgttcaaggtcaggaagcatccagcagaggtaaaaggaggtcagaagactcagccagtctagtccttccacattcttctacctgcttttattctagccacactggcagctgattagactgtgcccacccagattgagaatgggtctgcctttccttgtccactgactcaaatattaatctcctttggcatcaccctcacagacacacacaggaacaatactttacatccttcaatcaaatcaagttgacactcgatattaaccatcacatcctccaatatggttttcaagttgtttgctttctccccctctctttcagggatgtcaatgagtcaataaatttggtctctttacatttttgtatcacttagaatacttgaattgggttttgactttctcctgaatcttctttcctgtccatgatctgaattctacttctgtcatttcagccatttcagccttgttaagaaccattgctggggaaccagcgtgggtcattttgaggtgagaggacactttagttttttgagttaccagagttcttctctggttttttctcatctgtgcaggctgatgtttcttcaatcttagaagttgctatcctttgaatgggttttgttgcttttatcttctttgttgcccttaagggtttgattgtggtctaaggtggtttcagttgactggatttctttctggaagattttaggggtctaaggctcagttcagcattcttgagctgtgtgctctaactttgagggaatgatcccaggctcccagctttgttctcaggaccctcaaggttaggaatctgtggttctggaggggctgagctgtttccagactgcagtccataacaatcccatggatggtgccagccaaagtgctttgtctgagtggtgatagaagaattcatgtttgtttgcacatgccagcagcagtggcagcatggtgggttacatgttcattggtcgggctgggatgctggtgggtttgcggctgccagcttctgtgcacatgtttgctctgtgggcagtagtgtgaggggatgcatgcacacacatattctggcagaggaggggaggcaaggtccactcgcatgtgtgcacgctggaaggacagtggggtgagtgacagtgggcaagtgagtgctggcaaagcagcatgggggaggctgtggtcaggggaaggggcaggtgagctggtatgtgttagcagcagccgatctgctggagctctctgatggtcaggcacagtcagctgttgaaggagctatgatgtgggcccctgggaagcaccttggttgtctatccatcacttgcactgcaagtgggctctgccaggttggggccctggagcagacctagctatgttttactgcagacgttcccacaccataccccgtgagttcagcacaggatagagtcctgctcctatcaactctctacacagctttccctgctagctcaagtgtccatgggtgttgtggtatctcaggtttccaggattccagaggttcatggtgagggcaggttgctcctcacctgttcaatccaccccttccccaagagttgttgggggccaggaataagttgtggtgcatggtagtcccgttcagggttcccagcctcctcctcctttggcccagggtctgtgtcctccttctgtccaccctcaatgccttccctctgaagatctgctcatagtgcaccagttttccctatgtctcagtcacttggtggcagatgttcctcctgggtgtgtctggtcaggcatcttactgagacaaccttcttttgtttttaaaataaaaatatagagtaataatggatcttcattcctacattgcagcgattggctggacctaagtaaaagctaatactatttatattgggaaggcttatcctagttgcctacactcctctctctccacaagtacttcacattttactgctgaaccatgtcactcatatgcattacttgcatgactctagacatttgaggaacatgtaacatctgatccagaggaaagggagccaagctatacaattttgatatttctcctcttaatggtgtgattatctttgaggtggagagaaatactttaagcattttccattctgttagaaaaagaaaacacaaaaacaaaacccccaaatttttatcactaaatacagctttcttagcttgatgttattaaatttttacttatctgatctcctactgtctattttgataatcagagaacaacaatctgatttctatatttgtctatgtgtaaggaggaaatgtgctcaaatatgtattttgtttatttcttgtctccgtaaaagtgaattaatgacagcatattcataacatgcttggtgttacttgactatgtgagagattttgctgatttccacacaaaattccatctcaagtaatatttaccttttttattgtgaattaaaaattagtaatgttaatattgtcatcagtatcaatttatcgtgtattttattagtgtgatcctgtctctcaaggtctggttatacccaaggttatggttttacctgaacacttgcagtgtagagccaaaactaatgaattttaggtgacagcagtattacttcttaacatgtccctacagatttctgtagtattcacaatggagttaaatcatttgaagatgaggaaagaaaactttaccttgtttccatgttgagaacataagatgttgtggaagactgactgacacaatgtcttgtatggttcatgttgtgtatgtaccccatttctggtatgactttgtaacctctcccatcaagaagtgaaatctgttccccactcatgagttcaagctgactttttaatatgtttgcaccaaaagaatgcagtagaactgacagcctacaattttaagcctaagactcaagagtcattttatacttcaactctcccttgtgaaacccttccctgactgccatgggaacagaccaaggcatttttggtagaggtacagagtttacatgaagtgaggtcctaatcattttagccaagatcattctagagcagccagcctttagacaacccaatagctgactagaaacacattagtaagctgtgtaagatgagtcaagtccagcccagattgaattaccaggttcagtggaattacccacgcaacctatagactcatggggcaaactgttgtaagctattaagtcagtagttttcaaagtgtgaattggggtctcctggggatcccaagcaactttcgagaacaactgcaagatcaaacttatttccacaatgatactaagatattatttgtcttaattctcattctgtcacaatacacagtgaaggttttcaaaggctacatgatgtttgatatcaaaatagagtggatacagtagcaggtatgacactccagcagtcttctattgagttttctattgaatcatacacgaaagaaattagcgaaaatacaaagcactgctaaacttctcattaatttttgttttgtttaaaaaatgcagttatttttcataaaaatatactatctctgttacaggtaatcggtttattcttagtggtagaggaaataaatattttaaaatttatattttagtttacaatacagcaaatattaatagatgaaaatcgccaaaacaaagccctttggagtccttaatgattctcaagaaactgatattctgaaagcaaaatgtttaagaactgctgcactttttttctgcaacatttctttattctaggcatagcagttgtttataaagataaatcactataattttttcttcgtgactgtccgcaaaatgtaaagaatcaagtattagcatctttagaaatcaaaaacatttacttttctgcttcaagactgcatattggatctatctaaccagagtaaagttactgatgaaaaacaattaaaataaaattacatacacacacatgtgtatgtacattataagaatctttcattttgcatgaaagaaaaaattctacaaatactatgataataataaaaacagaaaccctgagaggtgaagtaatcaccaaagccagcttcctgtgtgaaaattcctaccaaaccttagaatgtttgagattacattttgactgcttcatgatgaacagaatgcaggagataaaccttgtggcccacccatagtggaaagtataatagcaaatgctctccctcataaaataagaaacaaacctcatggcgaaaaagggtctaaaaagaaatattcattcctgagtgctgcctggagaaaataaaagcaaaactaagaacttatccttattaaagatctgagatctgaatgaattcatgctatttgtttgctcaaaaaccaaaagcaaagcagttagtataaaattggtcttgggttgatattgccccttagtgattggcaggagcaaaaaatttaagagtagaacttcaagtctcgcctcaaagaattttcataaataacattttatgtgtgtgcaatcatagttaaaacaacagcaaaaacacacacggaaaataatagtccatgaatgaaattgatcatgaacaacacagagtgtaaatagaatcacaaataaaatagaaacttggattgaacataagaacaagaaaaaaaaagatgactaaatttttaaaagactcaaacagaatttcttaacacaaatggaatactctgtcaccataaagaagaacaaaatcgcgtcctttgcagcaacatggatgctgctggaggccattatcctaagtgaattaacaaaggaacagaaaaccaaatactccgtgttttcagttataagtgggggctaaacactgagtacacatggacctaaagatatcagcaacagacaccagggactactagagcagagagtgtgggagggagggagtgagggttgaaaaactactaaatcgggtactatgcttgctacctgagtgaatgtgatcattcatataccaaacgacagtgaaacacagttcacccatgtaacagacctgcacatgtacatcatgaacctaaagtcatatttgaaaaaatatgaataaaaattagaatattaaaaaagattaaatgaaaatatatcagctatgcagataaaatcagtgaactggatatagattcaaagtaataaataatgaaatgatgtgaaaaaaggaagagatatggaaaataaataaatggaagatattacattaaaggagatgctgactgaggagttccagaattgctggaaacatctattgacagtttcaagaaggctaacaaatctagagtgggatacataatatatccagtcatattacaaccagttttagatcactaaagattaagagaagactttaaaagcagcaagaagaaatgcaaattacccagacaggtgtaacaactgtctgagttgttacaatgaaaacaattgagttttcattaataaatggaatccaggaagcaatataataaactattcagtggtgcaagcaaaattactgacaatctagattcacaatgggggaaattatttttcaagagtaagagtaaaataaaaatactttcagacaaagaaaacttgacaattctttactaaaggaaatgatacagtatatacttttagcagatagacaaggtgtaaagtctgataagaaatggtgggaaaaagtagtaaatgtgtgagtaaatctcatataattaacttataatacaataataaaaattgctaactcttggaataataaagaagatagagcaaaactactcattaacacaacaatctggagggcttgtgagaattgtaagattctaatgttcttgtattttaggagaaagttaccaatattaattaccatcctctctgtgtgtgcgcctgtgtgtgtgtgtgtgtgtacctgcacaagtgtgtgcactctctgagagatgccttaattgtattagttgtattagaatgttttgctgttgttctctaacttgattttcttatatggttaacacatttccaagttttaatcaaagtatcacgttacatggcttgtactcagaaatgttcaagaaatgttgttaagagtttatcatgaaaacaacactattgaagaaataacataaaactgatgagaaaatattttcaatttaggcatgtgtagctactccaggacaattttacttattaaatatttttgataatacatttaaaaagtgtagtaccttagaatactaccatgaatgacatagaatctcaccttaagaaagacgctgtcataatctgtgctgtacagaaaccgttgataccctggaaaaaagaaagtctaatattactaatacaacccactggtttcttgctgataaaagtaaaataaaaagtattctctgtaataacttgccattttccatctaactgcattaggatcatatttataaaatctttctaaattgacagaaaaatatagaccaaatattttaacataatttatctgtgtatgcatgtcacagaatagacatacctttgtattaagttaaatttttcatttaaagtatcaaattaaatatttgaattatatataacataatatagagatacacacatataagtctcttttaatattactattgacgtctgttagtaaataaatatattttataatattccacttaagcataaagttattttccttaagaaagtacttcagtccgtatcactgaacttcacttcaccaaaaaggtgcacaggctagtctgttacacatttatccatgttattgatttttccatcacatataaaaggttacaacattcaagagattgttcctgttacaacagtataaattcattgcctggaacacagtttgctattgaatgtctgccagactgtgttaacaagggtattcagaagaaaactgtgaaggtataaaacaataaataagcgaataaaattctctaaagataacatgcctttaaaattatgtgtattttctttaagcaaaggtagtttgagaaaataaatatattcttattttgtattatcttttcccactatacataaacacatatttatatttttaaaaactcagtgctactttgggctatttaagtaactctaagtagaaccaattatgttgtttttcaaagtttggtgttatgtaaacattattctttcagacaagagtcaactgtgaacatttatatactcttgaggcacagattcctccagctctcctgatatctccatcagcatttctctctctacttaaatgtgccgtggtcagcttctgtggtcaacaacacctccattggaatttccacatttttcctctttgtcttcttccgtagcttccacagacagcaagaatagttgcaattggagactgacattttgaaacagtagtaggtattttgggattctcatgtcacataaactcattttttaacatgaagttatcttcacagccagttagtcatatcacagaacacagaggctaggacctaaaaccagatttcattcactggcatggagcagaagaaaagcagaacttaaagagacccaactatagatcccaagaaatttgttattcagaaggctgtagcaacaatcggttgaatcccatgcaagcattgtgtatttggtcacagcaaggtgtttggtttatggagtttatgttttcaatattatacatttgaaacatcgatgaagagaatctaaacattagaggtgatcaccagatgatcaggcaaccaggaaaaacagcattggttttgaaaatattataacaatgttcacgaccagaactcttgtaattggtcttttgactgtacttactagtgatgtacctttaaatataattcaggatacattttaacaggatctgattttttacaactagttcatgaattttgtgaaagactgatgaacaaaatggaattgcttattcatctttgtatggctatcatcaactagaaactttaacacactgtaggcacaggactttagaatcccattagtgatttatgaagtttatatttggctgataatttctcatagacactgatgaaaaatatcatgtacctgagaagagatatatatattaagccagatattcaattaaataaaaagtaattaagcaaagataatttcatctggttaaattaaattatatattatttttgtaaatattttgttatcaaatcaaaataattatgtgttctatttaggtagaaaaagagtatgaatgaaaatgaatattttagttttctaattattaatatttaacaaattaggtggtatcttcaatgtgaataatagaattgtactagatatatagtattagtactatatatctaattagtattagatagaattataatagatataatttagttgattttggatccatttttgtgtgactgtctcctttctgaagcattattgttaaaatggttagttttttgtactattgctctatagcatgatgaaaaatattttgagtcaagttgcaaataattgtgctagcataaaatatttcaaagagtttttaaaacaattggagatatgtttcatgtagaattttctataaattggctaatagaagtattttattattttcaagaaatttctaatattcaaatatctcatagatacttaaatatatgttcctaaatatatgtaatataatacaatgaatcaggttgccataataagataattatacatttttatcatttttagattttataaatgtaaactttgtttctgtgtaaaatgaaaatacatgtttaaaaaatttcagattaatggtaattgatttgctgcctcaaaaagagggccccaaattttttcattaaaaaaaagaaaggtaagtgaccaagccttctacagagatagtaatctaaaaattattgttgatttgtaatggttacagaaaagttttcaagataacaaaacctaacaagtgaaagtgaaattctacattaatatatattttgaatacacattcaataaatttctaattttgagataaacaaattatttcaatcatataaatgtcaggtattgctaaattgtatgttctattaaataataagaaatgcatacttcctgtattattctcataaaagcagtttccttcatgagcacatgaacagcttcaagaatcaaattgaccacactacatcactcagcaaaatgtattgcagattgggaacacaaaacatgaaagaaaatgaaagacagaaagataatctttccctcaaatctatgctcacctgaatcttaaatcatgtattattttccctttatatagttcttgatgggaatcttacagaaaaaaaaatgggttaaactgacaattcttcactgtcaagagaaacctatggtcagggatatatataattcccaaagctttcatcattaatattttatgaatcttgctgatctgtcccatctggaagaaaaatatatctttcatttgtgcaagcggtgcctgccaagtaataggtttcatctctataagctgagtggtgaaatgcaaacggcagcaaaggtactaggaggcaaagtgttcactttatttattttactggagtctggctgcactttattggagttgcagagtcagccaagcaaagcgaaagatctttggggaagtacgagtgtcaattccttgccaatatacctcagcctacacatgtgaatgcccacgtgttcaatctgacttttaaatgaggtgattagccacggtgactttttttttttaacataaatatatacaagaagctttggtgactggaacattggaaaaccattagctgagtatttgactttgtgtgtgtgtgtgtgtgtagatgagatgactaagagacaaattaataatttttggacacttctaacttaaaaggcaggatgttctgtcccttggttgggcatgacttgccttagctgaactaagaattttgtgtaggctcatctatgacactggagctgagtatcccctgggcagtattcaaacacagaagagcaaacagagaaagtgttctaagaccccctttccaagacataaacacagggcataatctctataatactggtctggaaaatgactttttgggggagattaagaccccaaaagcatagaaaccaaagcaaaaaatagacaaatgggattatatcaaattagaaagctctaaacagcaagagaaacaatggataaaacaaaaagatagcctgcaaaatggcagaaaaaattgtaaccgtgtatctcctaagttactattctaaatgtataaggaactcaaacaaactattagcaagaaaacaaatggtccaattaaaaatgggccaagtacaggaataaacatttctcaaaagaagaccaacaggtatatacataaaatgaccaacaggtatatacataaaaaatgctcagcctcactcattaccagagaaatgcaagtaaaattcatgatgagttatcacctgacctgttagaatggccaccataaaaaaagatgaaaaataagtgttagggaggatatggagaaaaaggaaaccccgtgtacactgatggtggggatgtaaattagtacagccgctatggaaaacagtatgatagtttctcaaaaattgaaaaaaagaactaccttatgatctagccatcccactactggttacataatcaaatgaaatgaaatcagtatgtcaaagagatacctgcactcccatgtttattgcagcactcttcataatagccaagatatggagtcaacccaagtgtccagcaatggataaatggataaagaaaaactattcagtcttaaaaacaagggaatcctgtaatttgccacatcatggatgaacccagaggatattgtgctaagtgaattaaaccaagcacaaagagacagatatcacatgttctcactagtatgtgggagttattataaaaaagctgaactgataaaagtaaaggacagtaggatagtagttaccaggggctggaatggaggtgtggagatagaaagatgttctttgaaggttatacaatttcaattagataggtgaaataagttcaagagatctattgtacaacagttcagtgactatagttaataacagcatattgtatacttgaaaattgctaagactgaaaaatgataagcatttgaagtaatgcatatgttaattagctcaatttagccattccacaatgtatatatattttaaaacatcatgttttacaagataaatatatccatcatttatttatcaattaaaaataatgaataaattagcttaaaaaaacaaaataaaacaatgacaacaaaagccagaaacacagtgggtttctgtctgttaggtttatctagttcataggtccaccatgagtgaagtgtgggcctctcatttggatgaaaataatttctgtagtaatgtatttagtgcataatcagaaaaaacatctcggttttaaaggagaattttccttcactaaaaaatctaaaatttaaaactccttgaaacggtttcccttttcttcagcaaacttatttcaatttttaatgaaatattaaggactgtgattatttaacatctttctgatcttttagaacataagaccctttctattttgtgcaaaattgtatccccagagtcttgcacactgttgacaagcagtaaatattcagtaagtttttgttgaaagatttgcatatttttcatttttatcagtagcttccaacatgttctaacatcataagcctcaacaaggcttggggtaagagtgatgatttattcaaactacagctactaatcataaatttacataaagcactgtgttagaaattgagtgatactaaaatgcctaagattaatttctgggcttcagggagttaaccgtctagttgagggaataagatatatgtgtaaaaataatgccaaatgtgaaatattaagtgactagagaatatatgagctgaaattgtacattagacaaaagaaataaaaggacattcctgataatgagaaccacatgagtaaatacattaatatcaaaagtctctaaaccataaatcatataagtgatgttgaggatgatggagcttagaatgactgacaaaagaacactatccctgtctataagaattatctaatccctgatctttaattgatttgtctatttactctttgtcatagaaaagcatgtgatttccatgtatgcaaaggatcaacactggatacacatgttaatataatattaccacaaacatataagggttttttttttctgacactcaactggcagctgggtgcttcaaactttttaaatctttaccatcctaaaatgggtgagggtaaagggagaatagtatcttgttttcatttgatctttacttatgattcaagtatcttttcacgtcttcattctctctttcagcctcagctcttttttcattcccctgttatccagttcatttgcctgactccttggcatcagcttccaggctatgcaatcacaagtggagcatatattcattttcagagaaaagtagccattcattgacactctctagctaagtaaaatacttgctagttgttactcttcaatggcttgactataccactagtttcaacaagttaaaaaaaattattccaggcattcttctggataattttaatgagttctgtactcactaaagcctttactttgccattaacttgttagctctattatgagctaaactttatgtcagtttgagaaaactattatttgagcttataaagcatgcagtatgtgaaatgagtgatctatttatttttattttttaattatactttacgttctagggtacacgtgcacaacgtgcaggtttgttacatatgtatacatgtgccatgttggtttgcttcacccattaacttgtcatgtacgttaggcatttctcctaatgctatccctcctccactcctccacccccttaaggccccagtgtgtgatattccccaccctgtgtccaagtgttctcattgttcaattcccacctatgagtgagaacatgcagtgtttggttttctgttcttgtggtagtttgctcagaatgatggtttccagctgtatctatgtccctgcaaagcacatgaactcatccttttttatggctgcatagtattccttggtgtatatgtgccacattttcttaatccagtctatcattgatggacatttgggctggttccaggtctttgccattgtgaatagtgctgcaataaacatacgtgtgcatgtgtctttatagtagcattatttataatccgttgggtatatacccagtaataggatcgctggatcaaatggtatttctagttctagatccttgaggaatcaccacactgtcttccacaatggttgaactaatttacactcccaacagtgtaaaagcattcctatttctccacatcctctccagcatctgttgtttcctaactttttaatgaatgaatgatctatttaaagtgataatataaaaatttaaagttaagtaggaaaataaacatactaatattggagaaaatatttctgtatttccttgattttaaaatcaaagtaattttctttaaagctaatatcaaactagttgaacttatattaattttatttaaaaaaatttcttttatatcctttagacctcaaaatttttgaaatttgcagattccataataatgtatttctaaaattatgtaaactcttttactaattattattattttcttttttagagacagggtctagctctgtggttcaggctggagcacagtggcacaatcatggctcactgcatcctcaaattcctgggctgttatagtatctaccgttttggtcttttcagtacatttctatccaattatgtaagtgaatgaaactctgctgccaaaaggaaattctggtcagatccctcttttttctgatccctttattggtttctcattgtttgaataaatacatttcttagccatatattttactcccaccaataattctatcctgcaactacactgaactacctgctattttccaaacacatttcatgtgagctttcatgcttcagtgactttgaacatatattccattttcctagacaatactttgattaactgtcacctctgcaggaatggctgtgacccctatagcaatattggtctctctctcttcttgggacttcaattagaggactaagtccatcttactgcaatctttgtgtgaatgtcagtatctacccaacgctgtaacctcaagggcagaaatcatagcatgccatttttgtgtttggaatacagtagatcttcaataattgtttgctaaatgactagtataataaattcatataagattttcccactaattggagcttttaagggaaatactttaattcaacaagatttctatagcagacagaactttgacttctatacactgctatttaagaaactaattttgatttggcagttgtttctggatgtctcaaataatatattattatagatttacttaaatgtaaaggctttttaaatctagattttaacctacattaccacacttctttgcttaatgattaaatgaacttttgcttagatttttataaaagagagagtaaataaaatgtacatttaattaacacagtgaatattttttgtatctacatatttcaattgttaatgggatttcatgacctaaattggccagaaaactgtaatattattttattacactcatgcatataaatgctataataaatctgctagaaagagataatgcaatcaaattaaaaagccccaccagaaagatgacagttttctttctggtcatttctttgagtagtttgtgtaagtggtataaatctcaaaaaatctataaaatattttacagtctgccaaataagatgttcaaattcctctcatgacttctttcagcaagaaaaatgaactcaatattatgctaatagtaaaaaatgtttccctagtagtttatataatattcaaaaaagcttacagttaattatgccttacaatttacagttctttaaaattgggaaatgctttaagcatattattgtcatcgactcatacaatagtcttatgaagcaagtataacaatttgtgatattaactttatttttttattgagaaatgaaatcctaaaacatttggtaacttatccaaggcaacatatatatgtcttctaggtttgaaatgaaattaattcatggtatatagtgtagaaaaatgtctttctctcttttgttgacatggtgtttctatgattttagtaaaaaagtaagagttaattcaactacaacaacacatgcttgaacatctaatttattattttatttatcttttagatgtaaaaatgtcttgtttttttcaagacatttgaaattctccccaattccaatcttactaatcaatggtcttacatgtatacaaacatttacaaagatatgcacatttatttaggaatataagtagatttaaagaatataatattttacaccaacatcttattcaattcatatgccacaacactccatatccctgaaagatctaacatgttttttgctttttatttgttttgttttgtttttcgaaacagagtctcactttgtctcccaggctggtcttcagtggcatgatttcagcttactgcaacctccacctcccaggttcaggcaattcttgtgtgccttggctgactgagtagctgtgattacaggtgcctgctaccacacttgactaatttttgtatttttagtagagatggggtttctccatgttggccagtcttgaattcctgacctcaagtgatccgcctgcctctgcctccctaagtgctgggattacaggcatgagccaccgcacccagccttaacatgtcttcttaatgttcacactagccctttcttcatcatttattcatctctttgttttaatatttgattatcccttcgttgttttcttctcctctcagaagaaaccatagttctctgcaggagctgggctcagaccagtgtttccggtttcctttctgctggttggaaactgacctgtcttctgcgttctctgtgagctacaggtagcccaggctaccccttttctcccttttggaagatacatccctgctatcagagcagactaaggatattaaaagcctcaatctgaagtggcttgtatagttgacagaggctacataggttgtagtaggcagatcttttagcacaaccacagtgggaaacttcaatgtagctgattacaaggagctaaagtgagaagggtcctgtccctttggttgttgctcctttcacttgcccctttctctgtatcaagaacaccagagcagcagcccctaacacaagactctaacaccgtgtaagataagttttcaaccccacactgtctaccttaaaatacaagtcagcacactgaaactaaccagaggaataagagacgaagatcttatacagaatgagaacgggaataaggcagaaagattaagaaaagacagcattttctttcaagacttttcttttgttatttcttggagggagagagggaaacacgcaaacatggctatctactaggaataatttagttaggtataatatgaaatgaggactagaacttcagtttttccaaaaaaagtgaagaacttggggtatgacagatctatttataggtcaagggctctactaagctttctgacacacaaaggtaggcccctaggtagactgacctcttctaaattgtcacttcattgaaaggataaagaattgtttttcaattatagaattttctgaggcctccaagtattttttgtttgtttatgtaaacaataaaagtatttaggaaaagttcaagcaacttttacaattgttttataaagagttaggaaaagaatggcttccacagtttaaaatatatctagttgtttaattatgcaaaatgcctgttatagcttatgtttatggctggctatttagtcgtatcatgatacaatacttgcaataaaatacaacctaaggggtctaataaagtagaaataattaattcatacaatcctaattaatcaataatatttaattataaaattatatcctaggaattaaaattttatgaaccctcgcattgagcaaatgtgtataatctttcaatttgcagctgttaaaatctaagagagatagcacaaaatgactgaagaaaataaatagaaacatttattgcttagattctgtatcttcagaggaaaatttatctgtagaattcagcccaaaagtggactcatttcttttttcaggaattagttgtaaggagtgaaatccttggtttgaagaaaaatcataagaaaaccccgtggtgggcagacatttcttggtgctcctgggggactgagctggccaggaaaattccattctggaaactaataggggaaatttcatatgcttcttgggggaacatgtagggaggaaggaaatcctgcgcccatcatttcacccagttttttcatccccaatatgggctttcaacttggtgacagagtagaggaagaaagccttggttaggtgcttcactttcaagaaaagagacagacactgtctgtggtggctgaatgggaacagctttggtctgcagctcccagcaagatcaactcaggaggcgggttatttctgcatttccaactgaggtacctggttcatcttattgggctggttggacagtgggtgcagcccaaggagggcaagctgaagcagggtggggcatcccctcaaccgggaagtgcaaggggttggggaattctctctcctacccaagggaagccgtgagggactgtgccttgaggaacggtgcactccagcccagatactgtgcttttcccatgactttcacaacctgcggaccaggagattcccttggtgcctatgccaccagggccctgggtttcaagcacaaaactcggcggcagtttggacagacactgagctaactgcaggagttttttttttgtttttttttttccatgccccagtggtgcctgcaacgcaagctagaaagaattgttcactcccttggaaagggggctgaagtcagggagccaagtggactggcttagcaggtctcacccccatggagcccagcaagctaagatccactggcttgaaattcttgctgccagcacagcggtctgaggtcaacctgggatgctcgagcttggtgagggaaggggcatccgccattactgaggcttgagtaggcagttttaccctcacagtgtaaacaaagtcatcaggaagtttgaactgggtagagtccaccacagctcagcaagtccactgtgttcagactgcctctctagatttttcctctctgggcagggcatctctgaaaaaaaggcagcagcctcagtcagggacctatagataaaacccccacctccctgggacagagcaccttggggaaggggtggctgtgggcacagcttcagcagacttaaacttccctccctgacagctctgaagagagcagtggatctcccagcacagcactccagctctgctaaggaacagatggcctcgtcgagtggctccctgacccccacgtatcctgactgggagacaccacccagtaggggccaacagacacctcatatagtagagctctggctggcatctggcaggagcccctctgtgaggaagcttccagagaaagtaacaggcagcaatctttgctattctgcagccaccgctggtgataccccggcaaacacggtctggaatggccctccagcaaactccagcagacctgcagcagagggtcctgactgttagaaggaaatctaacaaacagaaagggatagcgtcaagatcaaataaaaggacatccactcagagaccccatctgaagatcaccaacatcaaagatcaaaggtagatcaatctatgaagattaggagaaaccagtgcaaaaaggctgaaaattccagaaaccagaatgccttttctcctccaaaggatcacagctcctcaccagcaagggaacaaaactggacagagaaggagtttgacgaattgacagaagtaggcttcagaagatgggtaataacaaactcctgcaagctaaaggagcatgttctaacccaatgtaaggaagctaagaaacttgaaaaaaggttagatgaattgctaactagaataaccagtttagagaacataaatgacctgatggagtgaaaacacagcacgagaacttcatgaagcatacacaagtatcaatagccaaattgatcaagcagaagaaaggatatcagagattgaagatcaactcaataaaataaagtgagaagacaagtttggagaaaaaagaatgaaaaagaacaaacaaagcctcgaagaaatatgggactaggtgaaaagaccaaatctacatttgattggtatacctgaaagtgacagggagaatggaaccaagttggaaaacactcttcagaatattatccaggagaacttccccaacctagcaagataggccaacactcaaaatccagaaaatagatagaacaccacaaagatactcttcaagaagagcaaccccaagacacataattgtcaaattcaccaaggttgaaatgaaggaaaaaatgttaagggcagccagagagaaaggtcgggttacccacaaagggaagcccatcagactaacagcagatctctctacagagatcatacaagccagaagacagtggggccagtattcaacattcttaaagaaaagaattttcaacccagaatttcatatccacccaaactaagtttcataagtggaggagaaataaaatccttcacagacaagcaaatgctgagagattttgtcaccaccaggcctgccttacaagagctcctgaaggaagcacgaaacatggaaaagaacaagcagtaccagccactgcaaaaacataccaaattgtaaaggtcattgagactatgaagaaactgcatcaattaatggggaaaataaccagctagcatcataatgacaggatcaaattcacacataacaatattaattttaaatgtaaatgggctaaataccccaattaaaagacacagaccgacaaactggataaagagtcaagatccattggtgtgctgtattcagaagatccatcggtgtgctgtattcaggagacccatctcacatgcaaagacacacataggctcaaaataaaggggtggaggaatatttactaagtaaatggaaagcaaaaaagagcagcggttgcaatccttgtctctgatgaaacagactttaaaccaacaaagatcaaaagagacaaagaagggcattacataatggtaaagttatcaatgcaacaagaagagctaactattctaaatatatatgcacccgtgcaggagcacccagattcataaagcaagttcttagagacctacaaagagacttagactcccacacaataatagtgggatactttaacaccccaccatcaatattagacagatcaacaatacagaaaattaacaaggatattcaggacttgaactcagctctggaccaagcagtgctaatatacatctacagaactctggaccccaaatcaacagaatatacattcttctctgcacctcatcacacttatcctaaaattgaccacatatttggatgtaaaacactcctcagcaaatgcaaaagaatggaaatcataacaaacagtctctcagaccacagtgcaatcaaattagaactcaggtttaagaaactcactcaacctgtagtcccagctactcgggagcctgaggcaggagaatggcatgaacctgggaggtggaacttgcagtgagccaagatcacgccactgcactccagcctgggcaacagagcgagactacgtctcaaaaaaaagaaataaaataaaataagaaactcaagcaaaactgcacaactacatggaaattgaacaacctgctcctcaatgactactgggtaaataatgaaatgaagacagaaataaagatgttctttgaaaccaatgataaaaaagacacaacgtaccagaatctctgagacacatttaaaacagcatatagagggaaatttatagcagtaactgccacaagagaaagcaggagagatctaaaattgacaccctaacatcaaaattaaaaagaactagagaagcaagagcaaacaaattcaaaacctagcagaaggcaaaaaataactgagatcagagcagaactgaaggagatagagacaaaaaatcccttcaaaaaatcaataaatccaggagctggttttttgaaaagatcaacaaaatagaccactaaccagattaataaagaagaaaagagagaagaatcaaatagatgcaataaaaaaatgattaaagggatatcaccactgatcccacaggaatacaaaccaccatcagagaatactataaacacctctacacaaataaattagaaaatctagaagaaatggataaattcctggacacatacaccctcccaagtctataccaggaagaagttgcatccccgaatagaccaataacaagttctgaaattggggcagtaattaatagcctaccaatcaaaaaaagcccacgaccagacagattcacagctgcattctaccagaggtacaaagaagagctggtatcattccttctgaaactgttccaaacaatacataaagagggactcctccctaactcattttatgaggccagcagcatcctaataccaaaacatggcagagacacaacaaataacgaaaatttcaggccaatatccctgatgaacatacatgaaaaaatcctcaataaaatattggcaaactgaatccagcagcacatcaaagcttatccaccatcatgaagttggcttcatacctgggatgcaaggctggttcaacatataccaatcaataattataatccatcacataaacagaaccaatgacaaaaaccacatgattatctcaatagatgcaggaaagggctttgacaacattcaacaccccttcatgctaaaaactctcaataaactaggtattgatggaacgtatatcaaaataataggagctatttatgacaaactggcagtcaatattatactgaatgggcaaaaactggaagcattccctttgaaaaacgggagaagacaagggtgccctctctcagcactcctattcaacatagtattggaagttcttgtcagggcaatcaggcaagagaaagaaataaaggtattcaattaggaaaagaggaggtcaaattgcctctgtttgcagatgacatgattgtatgtttagaaaaccccatagtctcagcccaaaatctccttaagctgataagcaacttcagcaatgtctcaggatacaaagtcaatgtgcaaaaattacaagcattcctatataccaataacagacaaacaaagagccaaatcatgagtgaactcccattcacaattgctacaaagagaataaaatacctatgaatccaacttacaagggatgtgaaagacctcttcaaggagaactacaaaccactgctcaaggaaataagagatgacacaaacaaatgaaaaaacattccttgctcagggagaggaagaatcaatatcgtgaaaatggccatactgcccaaattaatttatagattcaatgctatccccatcaaggtaccactgattttcttcacagaatcagacaaaactactttaaatttcatatggaaccaaaaaagagcccacatagccaagacaatcgtaagcaaaaagaacaaagctggatgcatcatgctacctgacttcaaactatactacaagtctacagtaaccaaaacagcattgtactgctaccaaaacagatatatagaccaaaggaacagaacagaggccttagaaataacaccacacatctgcaaccatcttacctttgacaaacctgaaaaaaaaaaggcaatggggaaaagatcccctatttaataaatggtgttgggaaaactggctagtcaaatgcagaaaactgaaactggatcccttccttacaccttatacaaaaattacctcaagatggattaaatacgtatatgtatgacctaaaaccataaaaaccctagaagaaaacctaggcaataccattcaggacataggcagggcaaagacctcatgactaaaacaccaaaagaaatggcaacaaaagtcaaaattgacaaacgggatctaattaaacgaaagagtttctgcacagcaaaagaaacttttatcagagtgaacaggcaacctaaagaatgggagagaattgttgcaatctatccatctgacaaagggctaatatccagaatcaacaaagaacttcaacaaatttacaagaaaaaaaaccaccacatcaaaaagtaggtgaaggatatgaacagacacctctcaaaagaagacatttatgcagcctaaaaataaaggaaaaaaagctcatcatcactggtcattagaaaaatgcaaatcaaaaccacaatgaaataccatctcacgccagttagaatggtgatcattaaaaagtcagaaaacaatagatgctggagaggatatggagaaataggaatgcttctacattatttgtgggagtgtaaattagttcagccattgtagaagacagtgtgccgattcctcaaggatctataaccagaaataccatttgacctagcaaccttattactgggtatatacccaaagtgttataaatcattctactataaagatacactcacacaaatgtttattgtggcacttttcacaatagcaaagacttggaaccaacccaaatgcctatcagtgatagactggataaagaaaatgtgtcacatatacactatggaatactatgtagccataaaaaggatgagttcattttctttgcagggacatggatgaagctggaaaccatacttctcagcaaactaacacaagaacagaaaaccaaacaccacatgttctcactcataagtaggagctgaacgatgagaacacatggacatagggaggggaacatcacacaccggggcctgttggggggtggggggatagcggaggagtagcgttaggagaaatacctaatgtagatgacgggttgatgggtgcagcaaaccaccatggcacttgtatacctatgtaacaaacctgcactttctgcacatgtaccccagaacttaaagtataaaaaaaaagagacagtgaaagtgcaaattgccaaatgtttctttagtatttatttcattatatttcatttttgatgacattagaccatctttttcatcaacataaggcatgtagtagattatgaatcctgctggtctctgttgatgatcagatgccaaagcaggagtaaattttcttgacatgcagagcaagagttggagcagaaattgaggtgttatctcgtcatcacagcatgtagatcctggatccgtgagccctgtcagatggatttgctcctcaccaaaaaatctggaagatcctcaggtccttttaagcctctgctaaatgctgcacagatacctctccaaaatttcaaatttgacatccacttcagttaatttggaaatgctgtgtatgttcttttctcataccttactaaagtttctctgaccaacctgtgctatcaaacatatatcacacattttgttatcaagggcaccaaagcagatttttaaggaacaaataattatttgtttgtttttgttgttcttttaaactttggcttgcctttttggcagatgttctactcttcatgtcttaatctgctttgcaactatctctaaactatcctttccctctattaggaaaagtagcaagttttgtcatcatcattgatattagtttgtttttcatttattgttataattcattcattatgttactaatgaagctcttgtacttcactttcagggtttgtattttctgattccaaggatgcattcttatttttcagagttgatgtaagtcataactgcttctgttttcttttttaggaacataaatatatagataaatatgaatataaatatatataagtatatttatatgttataaatataagcatagcatatttatattatatatatatatttatacacacacacacagacacttccaggaaatgcctattctttcctctgtttgcttgtgtgaaggcttgtgccaatctaatctatagtcgagctggctctctgggctttgggagttatgaggcattctctttactattccagctttttatgcctctgaagatctctctctactttgctgccctgtccccttttacctgtagcagtacagtctatgaaagcccagtaaaccttggggtgggctttctcttctctttgttgcaatctttgaaagggtgtggccttgcactctgtgaagtccctctgtaagagttggttgataatatagtattgctttaggtgggagactccttaaaattcgaattcaccactccaacctatatgtggtcattaatagtttgttaaaaattggactggtttgtcctcatttctgtctaaagcagattgtctcctgctgctgcggtgccctcagggatgaaaacagtcatgtgagtcctttattctgggaaggtgtcatttttttctggaatttggtcatgtcattttgtaccttcagttttcggagttaaaaataatataacattatagtgtaccttgcttattgttaagtattattttaataagtatctccccacaaaactcttctgtttatcttaaatgaggacagccccaccaacaaatacagtaattcaagtcaaatctgagataatgtagatttactcctcaaatgttgtattcagtagcactggtgatccttccataagtgactgggttaataacaacactccaagctaacagtaaattaaaatatatgtgtgagttttagattttacatgggctatttatttgaaactgatatctatagtggaaaagtctccaatcttaatattctatgtatggcactaaggtggaagtgaacagtgtgaactatggcagattgggtaagaaaatgaatctacacaatattcttattctcagttgatgtctatccttccagttccccaggccaattacagtcattcttaactccatctttaaatccatgcccaatatattaggtaactgtgctggccccatattcaaaatatatccataacaatggctcactaaagttactactagcatcttggtctcagtgactatgatttcttacctggttttaactagtgtgtttttaactcatctccattcttttactcgggcaatgttttttttcccctccccacccccaatatattctaaatagagcaactagaatgactttattaaaatggaagtcagataatcaagtttttctacacaaaattaaataatatattctcatttattgctaaacagttgccaattacaatggtataaaaggcccttcttgacctggtgccttccttgaactcatctcttccatcagcagcagccacattgtcttccttggtgtcctgtgaattatgaggtcccgatgtaggaactttgcattggattttttttttttttggaaatctggaaatcccttctcctaaatattcccatggttctaacacttatcctccttaagtcaaatataataaacttaacaaagtctattctaactattaaactgcaaatttctccctccaaacaggcattctaatatacctgaacttgatcaatatttttcttctctatagcatttatcatcttttaatatgccatatgatttacttacttattttctgtcttctcacatttgattgccaagtttataaaaacagtaatcttttttttcctctgattgtttgctagtcacctggtaaatacttataaaaatatttgttgaaagaatgaatcaacagggaggtaaaagctagtacactactaatccacttttttgtgtacattcaaccaagatattcagcagcaaatatttttttctcaagttgcaactttaatataagttgatgatctataggaaaaattcccttggtgatctgaaatttgtacaggtggcagcagtttttatgggttgtggctctattatttttaatgagctgggatttcaaagttctatctatctctaaagatatttctagaaggatattcaaattgtatttgaatgaagtatatcccataatacagggatatacttaccaggacagagtagtaacctttccaacaggtccatgagcaatcagattcacaattctaattttgtagttgagttctaacaatgtagttaattattgatttttaaaaaaacatttgaccaagcaagaagcaaaatcattattttgccaaaaacagcacgttcctaatttgcctatggaagagtatgtaatgcttttaaatggggatgaaatctacattattatgtagaagattgttccttattctaaattgcagctaaagcagaaattcaaagcttatgaaataagacagatagtctcaagttaaaactcctaagtaatattacttttaaatacagaggtaggcaatggacaatatgacatggtaaagcacaaaaagagtaggacactgcactcaatcttattaaattcgctgtgaaaataccacagccagaagctattcaatttttggagaagttgggaaagtaccaaggtatcatgggaaaatgtagacagggaaaaaatatagatccaaaatgaaagtcaaagttaaaaagggtcatcctgcttgaaggaaaaaataaatctgataggtactagaaaccaaatccagaggatcagataaggcagaaagattttgttcagacagacccaattgttttttgaagaataatacaataatataaataatttatgaaatgtgctttgtagttggcttataacagtattgtttaggccataaaatatttgataactttacatctggctattaacaggtagctatgttgctcttcataagaacatacttttatggttaactttgttgctcttatgaaggctgctaatttgtgcaactccaggagcacattctattcacatgtaacataacactatgtgaatgatttcttttaacatcaggtaatatggtagcaatactacttactatgcgtcatagctttacatattttaaatcatctaatcatctcaacaattgtatgagttaggaatttttattatcccattttacatattcaagaaataaagcacataattaactaacttgcacaagttgaacagtaaaacgtgttagatccagaatttcagtacaggaaatctgtcttcatgatcagtgttcttaactagggtattattctgcctcttcaaaagaataattattgaacaccttcaatgttttggtcaccaattcttagtactaggaaatggcaacaaacataaaagccaatctcttgctctcattagctttcatttctgtgaagatgttcagactataagtagcagttaatgcatagggttttgtgtgtgtgtgtgtgtgtgtgtgtgtgtgtgtgttccaaccactattgaaatctctttataaatattaacacattctgtcctcacaacagccatttgagatagttgccatgattattcctcttttacagatgatagaacggagggcaaaagggttaagtgatgtgcctgaggttacagagctagtaaaacacatttttccctactctcaaatagaggactgtcactaaactaattatacagaaaagtctttctgaagaaagcaaagtaagagcttttttagaatttcctaaattttttttgttagctgtttttttttccccaaaacactttaaaattccaggtcaaaccatgcttttttattgtcatccacatgaaagaagagaagaaaaaattacaggtaattaatgaaaaaataaaaagccaagtgtatttacaagtatacaacatacatctgtatgtatatttatatctgtaaggctctttctagatagaaagacacagacaagtcaaacagatgcattttttcccctttttgttcacctcatatattttaaacaacgaagcaaaggatagatgaaaggatctttggatagatggatagatggattgattagatgagtaagcaggtagatggagagcgaaacagagtggaggaggatggaatgaagaaagttgtgagggagagaaatttccagattgaacaaaagaaatacgcaacagaatataattgaaaagtaactatactaatattttttacaccccttttatattgtgataatagatttatgaaaattatctagtttcttagatccttacttaggttgttttcttgtttggagaagaaaaatttttgagattcattaatctttacctgatatctgacatcattaacagtattgtgattttggaacacacgagaggactaggagttacatttctattcctttatgcaatgcatactccaaaacaagtgatatgctttggctgtgccctcacacaaatctcatcttgaattttagctcccgtaattcccacatgttatgagagggacctggtgggagacaattgaatcatgggggtggttttcctcacactgttgttgtggtagtgaataagtctcatgagatatgatggttttaataggggaaacccctttcacttggttctcagttctctcttgtctgctgccatgtaaaacgtgcctttcaccttctgccacaattgtgagggcttcccagccatgtggaactgtgagtccattaaatatatttttctttataaattaccccgtcttgggtatgtctttatcagtagcatgagaactgactaatacagtaaattgataccatagattggggtgctgttctaaagatacctgaaaatgtggaagcaactttggaactgggtaacaggtagtagttggaacagtttggagagcccagaagaagacaggaaaatgtgggaaagtttggagcttcctggagacttgttgaatggcggctttgaacaaaatgcttatagtgatatggacaataaagttcaggttgaggtagtctcagacggagatcagaaatttgggaactggagttaaggcgactctttaaaaatctgactactccactggattttggacttgcatgggccctgtaaagttctttgttttggccaatttcacccatttggaacagctgcatttacccaatacccataccccccattgtacctaggaagtaactagcttgcttttgatattacaggctcataggtggaaggcaattgccttgtctcagataagactacggactgtggacttttgggctaatgctgaaatgagataagactttgggggactgttgggaaggcacagttggttttgaaatgtgaggacatgagatttggaggggccaggggtgaaattatatggtttggctatgtcctcacccaaatctcagtttgaattgtacctcccagaattttcatgtgtcatgggagggatcgggggaggtaattgaatcatgggggccagtttttctcatgctgtgctcctgatagtgaataagtctcacaagatctgatatgtttatcaggggtttccgctttcacatcttccacatttttctcttgccaccaccatgtaagaagtgcctttcacttcccaccatgattctgaggcctccccagccatatggaactgtaagtccaattaaatctcttttagttctcagtttcgggtatgtctttatcagcagtgtgaaaacgaactaatacatgggaccttgtaatcatgtgagttaatacttaataaacatatagatagatagatagatagatagatagatagatagatattccattacttctatccctctagagaaccctgactaatacaatctccattactgaatagtatatcttaataagcatttggagtttgcattttgtagaataatccatatttttatagaagtgagtgcaagtataatgacactctatgtaaaactcttctatgtctcttacagtgctttagagccctcaaaaatggaatcactggtggtttttcttaattctttcatatggacctgtattagcttgttttcatgctgttgataaagacacacccaagactgggtaatttataaagaaaaagaggtttaatgcactcacagttccacgtggctggggaagcctcacaatcattacacaaggtgaaaggcacgtcctacatggtctcaaagaagagagaattgaaggccaaggaaaagagattttcccttataaaagcatcagatctcgtgagacttatttactaccatgaaaacagtatgaggaaaactgcccccatgattcaattatctcctaccagatccctcccacaacatgggggaattatggaagctacaattcaaaatgagatttgggtggggacacagccaaaccatatcgttgtgcccctggcccctcccaaatctcatgtcctcacatttcaataccaatcatgctttcccaacagtcccccaatcttaactcatttcagcattaacccaaaagtccacagtccaaagtcttatctgagataaggcaagttgcttccacctatgagcctgtaatatcaaaagcgagcttgttacctcctagatacaatgggggtacagtattgggtaaatacagccattccaaatgggagaaattggccaacgccaaggggttacaggaccatgcaagtctgaaatccagtggtgcagtcaaattttaaagtcccaaaatgatctctcttgactccaggtctcacatccaggtcatgctgatacaacagatgggttcccatggtcttggtcagctctgctcctgtgtctttgcagggtacagcctccctcctagctgctttcccaggctggcattgaatgtctgctgcttttgcaggcacatggatcaagttctcagtggatctaccattctggggtctggaagacagtggccctcttctcacagctccaccaggctgtgcctcaatagggactctgtgtgggggctctgatcccacacttcccttctgcaatgccctagcagagattctccatgagggccccacccctgcagcaaacttttgcctgggaatccaggtgtttccatatgtcttccaaaatctaggcagagattcccaaaccgcaattcttgacttctgtgcatctgcaggctcagcaccacgtgcaggcttggggcttccatcctctgaagccacagcccaagctctgtgttgccccctttcagccacagctggagcaactgggtcacagggccctgcccacaaaaccttcttttcctcctgggcctctgggcctgtggtgggagggactgctgtgaagacctctgacatgctctggagacattttccccatggtcttggtaattaacattgggctccttgctacttatgcaaatttctgcagtcagctgaatttctccaccaaaagtgaatttttcttttctaccatatagtcaggccacaaagtttgtgaacttttgtgctctgtttcccttttaaaactgaatgcctttaacagcacccaagtcaccacttgaatgctttgctgcttagaaatttattttgccagataccctaaatcatctctctgaagttcaaagttccacaagtctctaggatggggcaaaatgacaccagtctctttgctaaaacataagaagagtcacctttgcttcagttcccaacaagttcctcatctccacctgagaccacctcagcctggatcttattgttcctattgcaatcagcattttgggcaaagtcattcaacaagtttctaggaagtttcaaacttttccacattttccttttttcttctgagctctccaaactgttccaagctctgtctgttacccagttccaaagtcgcttccacagtttcaggtatcttttcagcaatgccccactcttggtagtaccaatttctgtattagtttgtttcatgctgctgataaagacataccggaaactgggaagaaaaagaggtttagttggacttacagttccacatgactggggaggcctcataatcatggcaggaggcaaaagccacttcttacagggcggtggcaagagaaaaatgaggaagaggcaaaagcggaaacccctgataaacccatcagatctcgtgagtcttattcaccatcatgagaatagcatggaaaagaccggcccccatgattcaatgacctccctctgggtcacaaccacaacacgtgggaattctgggagatacaattcaagttgagatttgggtggagacatagccaaaccatatcatcacacaataagccatctgcaggctgaggagcaaggagagccagtccaagttccaaaactgaagaacatggagtccaatgttctaaggcaggaagcatccagcacaggagaaagatgtaggctgggaggctaggccagtctctcttttcacttttttctgccttcttacattctagccctgctgccagctgattagattgtgcccacctagattaagggtgggtctgcctttcacaacccactgactcaaatgttaatttcttttggcaacactctcatagacaaacacaggattagaactttgtatccttctgtccaatcaagttgacactcagtattaaccatcacaagtccaccacttgtcaacttgaacccatacacatctcctgagattatacataatcttcaaataaagaaaataataagttcataataatatctgacataatacaactatccttcatgcaaccagaaatgcaccatttcccaacccaaatactattacaggaagtcaacaatacttaaatgctgatgtgaagtcaataaatcttacattacatgataaaaaagaaaggaaataaaacgaatatattttcttagtacaagcatataaatgcacaaagatgtttttaacaaaaggagtaggaaatactcatgacaattacagtcctcatttctggagttgctcctcacttctgcagctggtcacatggtcatagctggtattgatgactactttcttctactacccattctgaatacactttgccttcagcaagcacctcagcaggtcatagttttttcctgatggagtgacccaaaccttcatatctgaagggtccaagccatttgtagtcctgcctggattgggctgttgtagtttcccattgaccttaatcacagggcacggtaataatatgagattccctaatggatctcctgtactccatgcacactcttccttacctctgttatggagtagtagactgatttcttcctgatagcagaggtcaatcaccccagccaacactgtatctttcatcttagcctgttgacttaaatgcagaaggagcccaaaatgtccaggtggtaatcttaacttccagtttaatggaatcgttgttgttctcctgatggcagcgttcctccctctggaactaagacctctaggccagcaaaacataatgttgcgggaacaggaagcaaaaattttgctggtggatcactgggggtgatggtgagtggtgccacttacacctccaccccttgattcctggacccataaatcatggctatgggagaaacaatattatatattggatgctgattcagagcatcagccttctagagaactttgccccagccctgctaagtattgtcacctagctggcattgtaattgtgacttcaaaaggccattccaccattctgtcaatcaagctgcttcaggatgaaggggaacatggtaagaccagtgaattccatgagcatgagcccactgctgcacttctttagtgagtgccttgatcagagggaatgctgtgtggaataccatgatggtggataaggcattctgtgagtccacggatggtagtcttggcagaagcactgcatgcaggataggcaaacctatatctggaataagtgtttattccaatgaggacacactgctgccctttccatgatggaagaggtccaatataattaacctgccaccaggtagttggcttgtcactccaaggaatggtgctatatcgaaggctcagtgttggtcgctgctgctggcaaattgggcactcagcagtggatgtagccaggtcagccttggtgagtggaagtccgtgttgctgggcccatgcataacctctatccctgccaccatggccactttgttcatggcccatcgggcgatgacaggggtggctgggcaaagaggctgattgccgtccacagaatgggtcattctatccattagattattaaaatcctcctctgctgaggtcacccattgaggagcactctcatgggatacaaatattttgacatctgacatgcaccttcttagtttattactacttttatgtatagaagttattttgtaatacaagcaaacagttaaactcattgtattcatatcttagttgaatttctttttaaaattagacctagacgagaacagagcttagaaggaagaccacacaaagtagaagaggcttactaataaaaatatggtgtaagatgaaaaggcactgattatttgagaaaagaaaattaatgttggtgtagtggtggcagcaggtggaatgccctggttgaaaggagtagcatttgtatgttgggtatgtagtcaaatcctggcatagatgtagtacttagttaatatgggtttttaataaatcagaatagagggatttactcaatggaataaaaaagcacagaaaacaaccttagtatctcttagagttgtaaagggcccaagagactttttctccttttaattcatttaagagttgttcctagatatagccaacctcaaggcaaagtgaggaaaccctggtggacttgctgaaggtttaggaagcagcctcaaattctggactatgagatcaaaagagcaaggacaaactgtgagtccagaatggcacatttggaagtcttaaaatatctaaggacagccattggtcatcattaagtatcactatatagtatggtcttgtctgatgagaggatgcgggttggaatgagtgtgagttctatattcagcaaggaaaataggaatttccctggaaaattaccctgaaaacattcctatttactcaaaaactccataatattaatgatttatgtatataagtttaacaataatgtatatgggtaaatggattatttgtataagtgtgtaaaaataatatatataaaatatatttatatatacaaatacaaacatatttctgaatctttaaacactaaaaatattcaaacattaagaataaagtgaaatggagactactgggagcaaatttacagctcttaactcactgtcattccaggtcgtgctcattgaaatgattaactcatttagctaggcctctctctctctctttctctgtcaccttctttccatttttctttttttctttctacttgatcccctactctactcctgcctagacaggctctgaagttctccctgctgtgttctgttacgctagagggccatagctaagattccctcaccaagcatgacccatagtgccagtgctatgctgccatgccatctgtttatctcattttcgcttttgtttctgcctatttttccttctcctcccctctgcattttgtctcctgttgtatctattaataaacattctggctttagttatagagattgctatgttttaccaaatccaatatatttcctgtgtctgggcaagcagttgtactcactattctgggtaatttatttgtattattttaacccctagtaactaactccagcttttatcacacacttttttaatgttttctttatatttttagcttttctattctatcttgattactatagaaaataggcaacatatattttcacactggaaattatcaaatagagcatttaagaaatacctgaaaatatgtgaagtgctataatagcaacaacagaaggaacataaagtatcctcccaactgtgctttaatctggttataaaaacatgtcagagcgcacacacgcttgtgcacacacacacatgcacacgcacccacacacaccggtaccatgaattcaactggtatcaagacattgcaaccagagtttcatgtctagtgctgtaacaatggctgatgtttggagttatgtattctactcaaaattaataggcatgaaagaaaaaaaggagggacttattaactgaaggaaggatatattcaaatcaatatgttaccccatgaagttatcttcccagcgtgagcataattaaaaacacaattatggttttccattaccagaaaatatttttgggtaacaaaattaaagtatttaatttttagaataagcttatgtgttcagcatgaaaatacattttcaaaagaaattatacattaaatcaagtctataagtaatgcatatgttttctgagcattcaacttaaagaaaaaaggtataaatagaatggcatttagttgatgtgaataggttaccatttgtttctctgtgatccaaggggaaataaccagaggaagtatgcattttaacatagttttagcattccatgtctaaggaaacaaacatggttattgtggataataaaacaatagtagtgaaatataaaaaaaagacacttgaacagttcctgaatagtgaattttgctcccaagatgcatcctggcacactatagatggtaaggaacaataatgaattgacttttattgtcattgatttgttgctatggtgactttttgggatgacagaagtcagcatagtcaaagtgactctaattcgggagtctgtgatccaaaccagagacaaatgaacattgtacagaaattagggacctcattttaatctcctatagatgctgtttattataatattacatttgttttgatagtttttgttgttgttgttgttcacagaaatttacaaattcaccatgaatccactctggaatattcaagagctagtgttcatctagcacaactgataacactaggaaacaatgcctaaaatagcttttggaacatagaatggagaatatttattacaagaattgaatgaagtctggggggtgacaacttagtgacaattttccctgttgctgtgcatgaagcttgcacattgaggccttgttcagttgctgaggtacagaaaggaccaaaaagaacatgctgatatataaaagaaaaaaggaaaaaaatgtgctctaaacaaataaggccaactatctggaaatatccccccgttgtcctaagatataacattgccgaatgtgacaggctgtgggtcctgtctcatgggatgtgttgcaaagagtagacaactgaaatgcttgcttaaaatcttcattaaaaacatctacattataaagcctccatgtcactagagaatggagacattatgtagctcattacagtttgtgcagcatactgtctagggaccccttgcccagtgggagctcttagtagcagaatccttggcaggcatttttctgcagggaaagtatttctgttggaaacactgtgaatcatgcataagcacttcataagaatcccctttcagaaatgtcacaaaatggacaacagcacagtataataaaaaaccactagcctgagaaccagaagacagtatttctaagtctggcaatgccattaaacagtctagatgaccttaagtgaccttaggttggcctcactttcctcagctgcaaaatgaaggctttggattaaaccatctctaagcaatttcacctcaaaaatcttacggttctttttagcattgctgtgtctttctttccccagagagtgattccttggactaattggaaataaggtaaaggtttatactgaaaaaggaattggtaggcgacaattcatttgtattactgtatttcttcagagacaatctggagcatatcttttttgtcaaatgtgagatttatttaaaagagatttagtgcaacacagatcaaccacaatttagccatcttcagggaaaagagaaaataaacacagcacagttgtgagtagtaaatggcatattgtaagtttcagcacaaaatgatccaacagaaagtctaatataagtatcaaactattacatatgatatgatatctatttacaacttttctctccataaaatacatttctattggggtttattcattataaaaattagtgttatgggaaaataatggaagggtttttacaaatccaaagttaatttggatttttcaatggtaaaataattctaacatgttttattgatttatacttttatttttttttgcattttactctttgtcaagaataccttttatttaaattatcagtgccaatggaaaatgacatgaaaattattttcagagtatatcatatgttcatatatctataatcacatacaacctacaattgtttgtttcaaagacaactcagtctcaatctacccacaaatgaactcaaattatccttcccaagcatcctcttacttatgtgtcctttaatggtgtcattacctacctgtcatctagtcagaagcttcatttagtcataagcctctctttttgctccattgccatttaaataattgacaacctaaggccaattttaactcttttacaaattttaaatatatcatctcctcttcattcataggggcattgacttactctagacattcataccttctcatctgaaataattaaggcctttacctagctgatctctctgcccctggactcaaccttctctcattgattctcagtactgctaccagattgtttcaaaatataaaatgatcatgccactatttggcttaaaagtgtttgatggcttactattccttcaggataagattcagttttatagtactgtccgcagggttctgtatgatctgtctgcccctctctactgtcctttcctcatttcctgtcatttcctcacaagtatctgcactctagttacaataatcaggaaatcctcaccagcttgtgagtacaaataaaatcacagagacacgattgaggatgggctgtactagataacaataatcattgatggttagaacagaatggactcatacacagagtgaattatatctgagctacatcctaaatcaacatatcctggcttatcaccacaatgttccttgccaagtctttctgctcagctacatggctgtctcattatctgattattagctttcattcatgttcagaagacttatttctctggtagcttatgagcaatatgaatctctagaatctaaggttggcaagttgcaaaaagagaaggaatattcaacacctgtccaggatctatgtcttccaagaataattgagagaagagatgtttaccacagtcagtaaaaattctactcatgttgaacagaggtgtagctctcccatggaccccaaaaaagaagaatgtgagggaaagctcccaagcacatggcttaagcatggaagtttagtactgaggtgattttttcattcaacaactatttctgagcatcaactatttgtaaaatattgtcctaggaactgaggatagaagaagtccctgcgctcaaaaaactaacatttcatttttggagactaataggataaaaataaagcaataactctaatgtcaggtagtggtgagcattatatagaaaaataattttgggcaagggtttagaacctggtagggtaaaaaacaaggcatttatttttgaggaggtggttaggaaatgaagtgtgaaattaattttcctgcagtatatgaagtattgtaccagagtattaaaagatatgtaatattttattgataaatctattctttaaaaggaatacattttaggatgtcatcactttgatgtgaatcatgtaaatgttgataatattctgtgtattacacatttagtgtttcaagagattcacttaattgcctttttgccatgtatattatgtggtctatttgcaactgtttttttaaaaaagatattaaaagaatagttacatagagaaacattagtggatgttaattgtctccccacctatatttatgggtgttagcgcaactgctttgctagttgcaaagctgtattatcagagtaaaagtgtatttgtatactgtatgggaactaaaaattaagaataaaaccattttcttattaaaaaaaaaaagcaaaaggaaaagaggcctgagcaaatgaagtttgagcagatgactgaatgaagtaaggaagtcctatgagactatttggggtggctggattttgtttggaatgaaaagttagtatatatttctgaaacagaagtaatctttgggtgtttgaaggatggttgtaaggccagtgtaacctgagtagaataggtcacagtaacgaaaatagtaagagaggtagtgaggaactacgtgatactgggtctgatagacgttggttaagattttgggttttattctaagttataaggatgtgtgtgtaatactttttaatatctgaaaagccatgcactctcacaatttctatttcaaaatatctatacattctctcatatagtttattttttatttattttttaaatgttttctgttttgttctttcttaaaaagttatggacagtttcttttactgtgcagaagctctttagtttaattagatcccatttgtcaagtttggcttttgttgcaattgcttttggtgttttagtcatgaagtccttacccatgcctatgtcctgaacagtattgcctagattttcttttagggtttttatggttttaggttttacatttaaatctttaatccatcgtaagttaatttttgtataaggtctaaggaaggggtccagtttcagttttctgcatatggcaagccagttttcccaacaccatttattaaatagggaatctttccccattgtttgtttttgtcaggtttgtcaaagatcagatgattgtagatgtgttgtgttatttctgaggcctcttttctgttcctatatatctgttttggtaccagtaccatgctatcgtcagagtgaacaggcaacctacagaatgggagaaaattgtttcaatgtatccatttcacaaagaggtaatatccagaatctacaaggaacttaaacaaatttacaagaaaaaaacaaacaaccatattaaaaggtgggcaaagaatatgaacagacacttttcaaaagaatacatttatgcagccaacacatatataagaaaaagctcgtaatcactggtcattagagaaatgcaaagcaaaaccacaatgagataccatttcatgacagttagaatgatgatcattaaaaagtcaggaaacaacagatgctggagaggacatggagaaataggaatgcttttacactgttggtgggagtgtaaattagttcaaccattatggaagacagtgtggcaattcctcaaggatatagaactagaaataccatttgacccagcaattccattactgggtatatacccaaaatattataaatcattctactataaagacgcatgtacaagtatgtttattgcagcactattcacaatagcaaagacttggacccaacccaaatgcccatcaatgttagactgcataaagaaaatgtggcacatatacaccacggaatactatgcagccataaaaagaatgagttcatgtcttttgcaaggacatggatgaagctggaaaccaccattctcagcaaactaacacaggaacagaaaaccaaacactgcatattctcagtcataagggagttgaacagtgagaacatatgggcacagggagaggaacatcacacaccggggccttttgcgggtggggagcaaggggaggaatagcattaggagaaatacctaatgtagatgacgggttgaggggtgcagcaaacccctatggcacatgtatacctatgtaacaaacctgcacatctgcacatgtatcccagaacttaaagtatagtaataaaaaagttatggatacataatagttgtacatatttatggggtatatgtgacattttgatataagcaatatataataatccaattagtgtaactggggtatccattacctcaagtatttatcatttctttgtgttaggaacattccaattccactcttttagttttgtgaaatatataaaatatttttaactatagtcactttaatgtgctactgtacactagatattatttctatctagacgtatttttgtattcatttgtcataccctctttaccctcctctcccattacatttccaagtttctggtaaccatcattcttctctatatttccctgagttcagtttttcttttagctcccacatatgagtgagaacatgagatacttgttttcctatgcctggtttgattcactttacataaggtcctccagtttcatccatgtcgttgttaatgacaggactttattgtttcttatggctgaataatattttattgtgtatataccccacattttctttatccattgaaccactgatggacacttaggttgattccatatcttggctattgtggctagtgctgcagtaaacatgagagtgcagacatctcttccatacacgcatttcctttctattggatatatacccagcaatgggattcctgggtagttctatctccagtgtttttgaagaacctcaatactgttctccatagtgactataacttaattttccagttattttatatttctgttaaaattgtatcttttaatttttttctcatttcagttattttgttgcttctgtaaaatattcttggatttctttatcatatgttcaatacattctaatgcttatactatttctagtatttaacttattttacaattccaccatatagtctataagtaatgataaattggtctcttcttcattagaatttatcacttattttgacttggctctcagtttggacattgttggtgtacagaaatgcttctgatttttgtacattgattttgtatcctgaaactttgctgaagttgtttatcagatctaggagcttttaggctgagactatggggaacacaacggagttcacagtatgcacaaaaataataaaatacctaggaatacagctaaacagggagatgaaagatttctacaatgaaagttatgaaacactgctcaaagaaatcagagattacacagacaaatgggaaaacattccatgcttgtggacaggaagaatcaataatactgcccaaagcaatttacagatttattgctattcctatcaaactaacaacgatactcttcacaaaaatagaaaaaaaaactatttaaaaattcatatggaaccaaaaaagagcttgaatagccaaggcaaccctaagcaaaaagaacaaagttggaggcatcacattacccaacctcaaactgtattataagcgtacagtaattaaaacatgggactggtacaaaaacagacacatagaccaacagaacagaacagaacccagaaataacgccaaatacctacaaacatctgtacttcaacaaagttgacaaaaacaagcagtggggaaaggtgcttcaataaatggtgctgggataactggctagccacatgtagaagactgaaaccggagcccttccttatagcatatacagaaatcaactcaagatgaattaaagacttaaatgtaaaacctaaaactataaaaactctggacaataacctaggaaataccattctggacacaagccctggcaaagattttataacaaagatgccacaagcaattgcaacaaaaacaaaaactgacaagtgggacctaactaaagagcttcttctgcacagcaaaagaaactatcaacagagtaaccacacaacctacagaatagtggaaaatattatatttgcgaactatctatctagcaaaagtctaatatctggaatctataaggaacttaaacaaatttaaaagcagaaaacaagaaactccgttaaaaagtgggcaaaggacacaaacagacacttttcaagagaagacatatacacagagccaacaagcatatgggaaaatgctcaacatccctaaacattagagaaatgaaaatcaaaacggcaatgggataccatctcatattaaaagggccaactatgttaatagggctactattaaaagtgccaaaaataacagatgctggaggtgttgcagagaaaagggaacacttatacactactggtgggagtgcaaatgaattcaaccgttgtggaaagcagtgtggtgattcctcaaggacctaaaagtagaacttattttgctgtctttttcttttatggcttaaaatcttcaacttatagtctgtattatagcaattgtaagtattattgtcttcttcttatttcatcgaggtgcactttagatttaagccatttcatatgtttcatgtttgctgatggtttctgatgaatactcttctttatgtcaaatattatagtaaaagagatttaatactaacatagatgaatcacagtttaggcatcttcaggtgaaagacaaacctcagcaaaattataaatggtatattttaagttcaatgcaaagttatcaaacagaaagcctaatataagtataaagctattagaattatgtgaaatacatgtaaacacttccttttgctcttttgtttataacttgtttaagtaattgttgaagaatattttgaaaagtgtttcttattttattgtatttttataaaaagatgtatcctctatctgttaatacattgaaaatgtattaaagttttatttgtgggctattatatattcagattttgtgtctgttctataaacatagtacaataacatgtacatgcagttatagattgagcttgttgagtttttctattaaaattgttcatgtctttctcctcctctatcccactggttgaattgtcaatgctcaggaaaacatcttaaaattttctattatgtttattgatttagcaatttctctgtttatttctaaagtgttttgttttgtttatgtcttgtcctgctgattatcttgatgggttgccctattattaaaattattcatctttttaccatttaagcttttgtccttaaatgacattatatcaaattgaaaattaataaccattttttttgcctatcatttattttcaagtcacattttgccattttgctttaggtgtgtttctccttggcagattttacagtttgtatttgtttagtcaaaactgagtctttgtctttgaataccatattatttacccactctttttcataggtgatgtagttgatttcatttctttgataacaggtatttgttcccatattttaaaatgcactataaacatattatttatttattttttctttcctgggaaaatattggctgattgatcgggttttctaaagttctatttatctctacaaatattactgctcacaaacacagtattctcttctatttgggattaaccaaaattttgaatatacaattataatatagaattgtaagtgttattgtcttgttcttaatttcattcaggggcactttagattttagccatttcatagaatgtttgctgatagcttctaaggaattatctgtttatgtcaaatattatgttaaaagagatttagtactaacatatatgatggtactaaacatatttttcatgccatattcataaagtttatgcatatattcatttaaaaactttataaatttatatttatcataaacactatttctcatactcagtgtattctaccttgagatatttcatcttatttaattttcatttgggtggagcaggtcttctagtaattatcacccagaaaattcaggagtgatatactttctgaataattttacattatgttgtacctacttttagcccttaaatatgtatgatatattggttgagtgtaaatattaatgttgcagtacttttctctcatgtttctgtaaatattctttacttttttctagattctaataccgcaatgagaagtctaataccagtctatgtattttttccagagtgacaggtttagttcaaggctagcaattcttttgtgaccatatatacctctaaacaatgacaatttactcacactctttcttgaaaacccaaagccacagtgagcttggacttcttctccagattcattagttaattcacagtttaactataattttttaatacttttttttgtttgtttagaaaggtaggaggataaggaataatgagcacatgcttgggctaccttcctagattctttctaaagtatatttttaaaaatcctgacagccaaaaccaattgtttaatttaccatttaagaagaataatttagaagaaaacaaaactcaatttatttacttgtaatgatttatataaaaaattaaacatgtagttttatcttcccttttcctgtaaaatgtcacataatgtaccaagtgaaatgagaaaacaataaaaatgttaaaaactgaaaggaaagaatctgaaatacgttgaactgcccacacaagaaatattctaattcttggagcttcagtagaaatattttaaaataaaaaaatgttgccttggacatttctttaaaaaatgaatttattaggaaggaaagaataaaagcagtatccttgaataataacaacttcctaagatttgagtaaatgaggcagaaacacaaaacctcaatgtataattgtcaacatttcataacatgaatattgtgatgggctgttaaccattttccccccactggcctcagatattaacattaccatgagaatacttaggatattttttgttttttatgaagcattaatgcactttgatatcactagccaaatacaaaagaaagcagagcataaagtggctaacaggaggattaaaagcagagcataaagtggctactcaggcaggaggaatttaaataccaatgtcagcatctagagaatattagatttttgttctgaaatggctgaaagtctcaggcaaataataaacagcaaactcagagaaatgctgagggattgaaagtcatagctttataatacctcttttattttatgctattctattgaaaagtgacttaaatatagaatttcagaagaaaataaaaatgatgctccttgatacaaaggtatgtttctgtatatctcttaactcgatggagagcccttgaagtatatcataacatctctgtattaacagaagcttcacataacctgcaagttcctgcctctggcattcaccagagacacaaagacattacgagaggaaagctacccttccctttatctaataacagttcccttgagagaatcccaaaggcactaaggcatgctttctagtatcacaggaagaaccagaaattgcctttccttttcttttttaactccattctctgcaacaataactaagtatagtttttctcttgtcaccctaaagtaacctttggcccttcagtcttctctgatatacgacaggacaaaaatacctacaaaaatgtcaagtgaccttttgtttttcattgcagatcagaattctctcaaataatcacacagctacctcatgctcaaacagaaattagtgatggttagctacaagcaaaatttttaaaattgccagttgacatgcagaagcaatcatggccttatagcatacttcattctcaacatgtttgattaagtaataatatttatatatcttggaaggagctggaagaaaggtggagataaattactattatcctgttgttctatttatcctagttatttatataaattactatattaccctattgttttaaattactattatcctattgtttatctgaggcccagagggtttaaggcatttatttcacaagaacacagttataattagtgatctaaaacactaaaaaaagacgctaaaatattatattattaacattggaaatatgaatatgcaaaatatgtgtgccccagggaaatttagtacttagatttagtgctaaaatttcaactaaattctcaattaactctgtttttcatttatttctgagttccaagaggacgctggatcttaactttaaccttaaccattattctcaagcatctagacccatcgtctctttatcattatatttaatttaactgacacttaagtgcctgcagggcataggcctctaaagagttatgacaagaacacacagtatctaggaggcatatgacggttcctttaactcatcatttaaagccatccctccaatcaccctcttttttttattattatactttaagttctaaggtacatgtgcagaacgtgcaggtttgttacatacgtatacatgtgccatggtggtttgcttctcccatcaaccggtcatctacattaggtatttctcctaatgctatccttcccctagctccccaccccttgacagacccctgtgtgtgatattctcctccctgtgtccatgtgccaatcaccctcttaacctcactgaaactttgtctctattcatacttttatctatctaccatataatgtcagaaagaaatgaatatgtccttctttcaaagctgaccctgagctttcatctgttccccttcaaaacatcacttcccttattactaaatcttctttcgaattttatcactatgttcctttctactgactctttccactctgacatcatacagctaaagttctcatatttttaaaaattattttactttcttgattctgcataagcaactttctctcttaacccaggattctatctaatactttgacagtatgctttcagtaagcattcctaaatgcttatgtaagttattcatagcccttaaaaggcccttttaaagccaggtgcagtggctcatgcctgtaatcccagcactttgggaggccgaggcaggtggatcacctgagctcaggagttagagatcagcctggccaacatggtgaaaccctgtctctaccaaaaatacaaaattagctgggtgtggtggtactcgcctgtagtcccagctactcgggaggttgagacaggagaatcgcttgaacctgggaggtggaggctgcagtgagctatgatcgcaccactgcactctagcctgggcaaggcagagtgagactccgtctaaaaacaacaacaacaacaacaacaacaacaacaacaacaacaacacctacaaggcccttttaaattactcttatttacctgggaaacgtttcatgttttctcattctacaaataggtcacctccttaaatgtagtcttaaattccttgggcaaacttagttgctactatttctgtgcttcttcaatatgctataaattttacatttcttgcatattcttgtaattattagtttacttttatgtcttactcatagacactgaagtttcacacgtattcaatgtatttatttcaaattgcaaggtgaataggatattgccagatttagagattgtgtaaaatatgttcaatgagggaaatgaaaaaggggaaaacaggtaatgtgttgatgcaagtgagagttcaatgaaatattgtgtgaatcatggaaggacagaagaattgagcaatgttatatgtacaaaactaagggagagaaaataaggttgtaaaattacactgaaaaagaggatcttgaagatattggccaaaaaaaggaactgtaatcttggcatgccacgatttttgttccaaaaaattgacagaaaagatcagtaaataaattatttttaaatattctcaaatgggtggaaaggaagttgtcatgcataaattatccccaattgaaagtaaacttgacaaaaactgttgtatcttcgtaaatgccatgtatatgttataataatattgatagatgtgaatatgtatacatatgccttatacactgctaaatattttatatactattttaaaagacaaaagtatatcccagaattaagctattcacctaatgtactggcagatatcctaatctttttaaatctcttttattattaaaaataggattacacgaagcctgctgctcagatgaattttacaaagatatgttttcattaaaactagtttttgtaagtatctgtcttcttttctttcttttatttctcctgagtatgaggccttgaaatttgtgattgctgtttttttgcttggtatcatcttatgccctttgcccctgtgaggaatgatgtggatttattcttcttaaaaagactcaattagcacactgtctctgaatccttctaactttccttgtacattaagttatagattaaaggattacagagccaattcttcctttagaaagagacaagagtagaggccaagatagctgctcactgtcacagcattcactcagcaaaagctgtggtggcagagaatgttagctatgttcccaatatccattctccccttcttccttagtttcagaaatccaagttgaggaggtagtggcattgtactcagatttaagaacaatacattttctagatttacatactgatataaatgatgtatgtttaagttttgactaatgagatgtaagttgaagttgttggttgcacctttgggaaaaactttataaagagacttgatgactagcgcatgctcttcacatgaacaatgcttggagatccaggagttatcttgaaagaatgaggaaaaatgccctactttaaagtatatatactcccagatattaatacagtccaattaatatttttaaaattaattaaaatatttttgtctggtatggttctgaatgcatatttaagtacattttgttatcttattttttatttgaaaggatgctttctaattgctttttacaattatggacaatatttacctggttttggaatctttattctttgaacatatttccttttattagcaactactttaaaatgcttaaatgagtttttaatgcattatttaggcatgattgcattttattctaggggctacctatctactcatgctttatgcatgcttttagctttccttttctttttgagtagagaggactattttcttttttttttttccttcttgtaaggaatattggaactcgttggcaacttctttttactacttctctccctctccatatcatctaatttgaagtaatgtcctactcctattcaattcctgtaaatcaaacattaagcttattctactttacttatattcatctctgtgatttttgatatttgtgttcatcgtgtcagaatatacaatcattccattttatattgactattacttagtcttaaaatataggcaaatacatatttaattattatcaacactgcttacattgatatttctctaatcctttggttgcctaaagggtagagctcattagaacaatatttctgaaattctccatgtttatagcagtttgtctgtcacctatatacttgaatcaactttggctagttacaaaattcttggcttatattttatatcccttgttatctaaaatatattactccattgtttctggcaaaaagaaatgtttgctgtcaaagatttagtagcagtctctgttttccttataagtatttcatcatttttgccttaatgcctttttaaaaattctcttaagttcagtagtcttactagaactggtgttatttctggccattataggtcacatacatggcatgacctatcaatatgtagtttcttatttcagatttttaaacatttatttatatttgttttgctcctttactttggtattcttctattacttgcctatcttctatattttttacttcttgaattaactcctcccctcccctcccctccccttcccttccttttttttctttctttcatattaaaaaaatccccattccatcttctaattatcttaattggttgtctgttgttttaagtcactcttgtgtttcttcaagttttaccttcacttgtgaaatatttttctaaaataatttgttttggattacttttttttcctcgaatcttttttttatgatcaatttgtcattgagtttttctaattctgatttacgttgttcttttatatcctctatcactttttacatttagttacttgaaaagtagagggttttatttttcctgctgttgggatgctattctgttccttattctcttttctttataataatgtcataacaatacgactaaaatccttgtaaagttctattaccctagtttatctgtagaggggattcttccacctaaatcccatataatatatttgtggttgtctcagtacctgcaatcatctgtttgcaatgctgatttccctgtcttctcagcctctttgtcttttttaatatctcggacttagttcatttcttttgctacttttccaatttatatactatacatatgttgtaggttcatatttcttcagaactgtatgtccatgaagcatacattcatctaccagcccttataaaaccaaactgtgagctttctttcaagttcgagtatattataatatattatctccagctggcatgtttgcatacaatcttggtctcaaaatttcatcattttaaattgttttgtcactaaataagtcctgattcaacagtctgttgctataaagagtgttgtagcttattgtgaatatttaatttaagtgttgtattgcaagaaccattgataagaggaaagttgtaaggagaaaaataacatatgttaacttttgtagaaaataatttggcttgaattgatcacttgtttgccagaaaggcaccacattgactttagaataacaatgaaattggcatccttgctataatcctggatactaaaataacatgttgattaattactggtatcaacatttcttctggacattactcttttcaatatcacatttttagtttgcttaatataaatagttatgacataaaaatactccatttgcaaagtttttggaagatttccatagaaatatactggaaattaccataagaccagagagtatacatctttgaaacttgccatggatttagaaatttcattatatttcagcatttgcttatcagagttatttagtatgtattgaggaaagaaactacataggtgtgtttaagtacttttaattcatttataattagcctattatttccattattacaagtaattttatgataaattttattcaaactaatttctacaacaatggaaagccccacgtacctattaagtaagaaatattctctaccttgaaatgcttgtgttatatatgctactactgcatcttcccctgaaaaaaccttttagcttttcaaccagctaatgtctcatttccaagataatgctaatgagaattttagtaaaatagagggtagcaacctgtcatttgacactcatcctgaaggaaggaacacctgcctgaattacatttagtatcagttaatagagtctttctctacacttttcaaatggctctatgtttagaaaaacatttcctaagagaagcatttcctgtactcaagtcatattatatgtaatacataaattataatttacagtgtttactaaaagatgacaatgttcctatgaaaaagttaaaatgattacagtttattgtccttcatcctcctgctatgtggcctctcagcaatttttccttttttatcctttaatactggaatatgtattttcaaggtaatttgttattttgtttcttggtaatttgttattttgtttctttttgctatcagttatgaatctgtctgaaatgatttggccacatactatgagaaaagttttgatgcaactacctgtaaatttacattaagttggaaccattgaggcatgtgtgactgagtgccaatgagacatatgctggcaccatcatatattggcttctttttgtgcattgtttcattttggttccccttgtttccacagtgtgtgaatggctagaaggtagaaactatatattagatgctttttgcaatcctgctatttctgctacagttttaggtgacatattaagtagtcagtcctccttaacctcctgtccttgatcactaatttctccataactaacatagatcttttaaaaatataaatggaatttactatgcatgtgtgtatgtgtgcacatacataaaatattttggtgcttctaaacttatatattgcatgtattcttctgaataacttaaaattattgcacataatgtttgtgagagctgcatttatatactaagctaattttatttttcccaagtgaatagcaattttctataataattatttacctttttcatagacaatgtcatgccaacctaagaaaactcaaattgtaaaatattccattcaattacagataacctttcttctcacttaaaactacttagaatagttagaagagaatagttaggcatttatagaaattctacctttttaaaataaattgtattataattcatttataatttatatgagtttatatcagaattctctaattatttttaaaatgttttatatatctgtctcaataactcctttatttattacatgtggtgtgttatatttttatggtttgagcttagaaaaatttatacaactttccaaattccaccagaaagtgattgctcaccattttaagattttttgtctgtcagtgaagatcgacattttcttttttcatatagaactttcatcttttcttctgagaattgttcctcactatttcatagtttggctggattccatggttatttttattcaaaactttttggttattaatttctttcttttgggggggggcaaaagaagctttctttctttttctttttcttttttatttattatactataagttccgggatacatgtgcagaacgtgcaaattctacaaagaacttaaacaaatttacaagaaagaaacaaataactccatcagaaagtgagcaaaggatataaacagaaacttctcaaaagaagacatttatgcagccaacagacatatggttattaatttctaaagaagctattgtcttgacttttttcttttcttaaagtaagaaatcagttaaaaggaaatttccctttgaatttttatagtgtgtatatttgttgtttattttgttcatagagtcacattctaatttttagttgtgtttttgccacaaaatctgaaaattgtagtttcttcaggatatgttgcattttttgtggcatgaaacatggccaattttcatgaatattttatgatttattttaaaaattaaaactttctgttagttaatgttttagatgtgttcttaatctgatttaggggaaatgtaagtttttctattaaacatgaattatcatttaccattttctcatttcatctatattagtgtctgctctctacattatgaaactacattataagtgcacaaaaactttttactaccttagttttttgaatcttttattctattaaattcgaatagcatttctattttattatctttatgtttaatctgtatttcactttatttcatgcatgtctccagaaaatagtgtatgccagaaattttttatcctaatgtaaattttcttaatcagagaattaattcatattcaggtttattactgttacaatgcattggactcagcaatgacatcctgttttatattacttattcactctttcctgtttttgctttcttttttcattttgtttgattgaccaaggaatttgaagtagtaacttattttatttggataatttagaattcctacaactaattcctgctcttcttaaagttaccattaaattattaaacataaaattttaaaatagattttacatcaacattcaaggttaatgattttttacaggctaattccaaaaaagacaatattttccccttttgcctgcccccaatgcccaccaccattccatgttgagatcagctataacatttgttaattaaaaaaatataatgttatggaaattactttgacatatacgatggtttgctactttcattattctccactattcattgtgtagagtgtatatattcataattggtaaatttaaatgtgcatacatttaaaatttttatgtaactatacttattttctatctctagggtccagttctagttaatgtaaggaacaatactgtcacttccagacaaacatggtcaaataaaattttggatttttttccacctgtttctttactgataaatattcataactggggctagcacagtaattgaatgttattagagaaaagggaggaaaaagatagactatatacttctagatacttgtggcatacataattgcaagattgtcttcataatttatgcatcaaatctaaactactgcataaaaattaagccgttcacattgataaagcgataactaacaacaggcaagtgtatttttcctattttttttctattcacttctcaactgtaatgtaaaaatagatttcatattctttttcattctttactaaggagacactatttttttcagagattcattgaaaataaatatttactaaggatctacagcattcatttttactctgtaagacatggttgctgccttcaagatacttagattttgttcagtaagataagggataagactgaaaagtcaatgaacaagggcttaagtaatattttggaacatcaatgaaagaactcatgtgaacattcataatttactgtgacactgttatttacacagagggtgtctattagtggagttcaaaagagggcaagaccattggcctttacaaagaataagtattaaaggaaaaattcttaactgctgcttgaaatatatcaaggatgactggggattttttagatgagggagttgagatagtaaagtaaagataaaataattcaagagattaaaaaagtccataattctcagtgtaaaattatcttttaaagacatctttctaaacatagagattgctaattacacacagccctccttagagacacatagtatcaacctgactgctcctgtcagattaaatcacagtgggtactttacaatcatctatgtaggtaaccaaaatggtagtacagtaaaagctgcatttactttagggtggtgctggtttgagagaagtgtagcagagatatgatttagtctaaatactcagaaaattaatgcacccctgctactctaccaactgactttgaatttaatgagaatgtgtatgcatacagatttaaaggctatgcattatgaatttttgtctttgtgaactaaaattaacaggatcaaagtcttaaattcccaagttgaaaacctcctactgaatttcagataacaaacaatatttttcccaatcctttttctgatgaaaacttctctttggaaagaataatgtttcttatccaaaatataggctgacaactggcctaattaatcacaaatgacagagaagagaaataaaataaattataaatatttaatgtctttcatatcttatttgaaagatttaaccatcgcacttcattaaaatataaacagttagtgggagaggaaccaaatgctgatgtaaacttgaataactaaaatataggatatcaacaaatacctgcatattgatgtagaaatggaatgaacacttttttttgtaatgacaaatcaaacttctttaaagctgaagataaattaaagagccaaaggtttccaaaaaatgtagcattagctgttctagtgatcttaagtatttctttttacttaagaaaaattactttaactgcagtaatatatgttatgtaaaggcatatcattaatctagtgaaaacaaaacaaacgaaaagcacagaaagtgtatttacctttatgagaaattttcaaagcaactcaaaagtaacacctattggaagtaaaaattaatgaatggaatatggcactaagctaataagttcatattaggccatcaaagtagtttagaagtgaagtatttttagttctctaatccattaatttgacaaatggtttaatagctgaaaagagaaatctcccggacagtatcagctaacccaaaaatcaaatgtaagatctgcataaaggagaaaggggtgaaagatatcattctaatataattattcttagtagtcttacccaacactaatcaatctttacaaaacagtattttttatgttgaagactgcattacaattctcatacatctaatgtttaccattttaacatttaccagtttttatagtcttaatttttttagaatagccatttaaatttaataattcttattttttttgcaacatgcaatagagaaacaggaaagttagcacaaatgtatcagatattttgcaattgcttatattggcaaaaagggcaaatataataaagtatttataaaaagaaatacattcctaatattacgtatttttattttaagaagaagagctgcatttcaagtatttttggcattttgaagcagtggataatgcctgcattggctccatattctgattggagatacagctggtaccttgactgacttagataatataggtcagctagggagttaaatcccagtgggggctaactggtgatcacaaaaagctgtgttccaaaccctggaaactaggaatgttaccttataaggcaaaagagtgaataatattttatgtggcagaaaatgtataatgaaatacaataaagcagattgagacaagggaattatccagtggccccaagtatatgcatggatttctttctaagagggatgctaagcaagctttgagacaaacacacagaatagaacacacacagaaaaggaacagacaatgtgactacagagccagagactagggtgcaacaagtcaagaaatgccaactaccagaagctggaagaggtaaagaacagattattcttcagagcctctgtagggagtgccaccttgctgatgtcttgattttggacttctgatcttaagccaccttgtttgtaccaatttgttatggtagccacaggaagctgattgatacacatcctttttgtttttttcttttgtctgtctaaactaatatacccttgtgtcctgtggtttgaactcaagctgccatcatctcaagatggggaagggagaggacatctgacccaagctataccaataatagtattcttccctcgctcatgcagccatagtcgattaggcgacctgcttaaatttgagatcctctaatataagattcttacattattcatctttcatttattgttgcatctctagaagttagttatgccagccatatagtaggtatttaataaaaatttgatgaacaaattatttgtctaaattagtttttcttcagtgtgaattctggctttgacaaattattggaaggtcttttaaaagacctcaaaaagtaaacatagacatttaaggggatcccaagtccagaggtctgaatttcctctgtctgggcactttattttttatcagctttattggacaaaacaggagacactaatccaaagttggaaattgggatagatcacattttgaaaacattgtctctaaagcctgtaatctcagcactttgggaggctgaggtgggcggattgcttgagcccaggagatacagacaagcctgggcaacatgcaaaactccgtctctacttaaaaaaaaaaaaaaagaaaaatacaaaaagttaggcgggcatggtgactcacgcctgtagtcccagctactcaggagatggaggtgcgacagtcaatcgagcctaggagacagaggttacagtgagccgagatagtgccattgcactctagcgtaggtgacagaacaagaccctgtctcaagaaaaaacaaacaaataacaacaaaaaaattgtctcgtaatatttaatattatttttctaaaactcttgagtaagttgatttctggggagcaggagatgggctaaaagaggtaagatataacaagctggaagaaaaagataacttttgttttcagtcttaatatcttcagggttcagtttcacaatactctcaatattagatattcatatttacccttagcaattgaaattgcaattttacagaaaatcgaaataagccatagtatttgttgaatagttcatatataagtgaagtatgttttctgaattgaaaataacctttccattaatgcagattatgtatcatcttctaattttatacacgttagttatcagaacacttaggtaacatattaaattcaaaattacacggcaaacctgatttttttttaacagaccgtgttcctgggttgatgcatacttaatagactccaatacttttaacagggttcagagttagacactgagttttgtctcatgtatcctcaccttaactatccgtggtactaaatttagaacacagatggacttaattacaaaggccgttacatcttatttaaatttacattcctttttcatgaaaaatttatatgtaaaggcaggtaaaatgtgatattctaaatcaatcatatcaaggcaaatggtaaaattacatcatccacattttttgcaacgatttcatcttggacttaagaatacattgtttaaatatctgaggagtgatcgttttgaaatttagggaatctattttcttcctccaataagatttggctttataaactctggggtgaagggcaggggagtctgattgaatatcagagaatgtcttaaaaacaaaacatcatgaacaacaaaaccaaaaaccacataatcttccaaaaccacattaagtatatcatcttataggaaaagaattacatgtatgattttctaatttctcacacaggcctcattagcatgtacatgttatcaaaaacaataaattaatagcagtaaaatttttatctcaaataacctatattgattgagttacacatattgtgcagcatctatctcacgtttcctataaaggagagggaagaacagaactgtaagaaataccagcaagctacatatcagaaaacgaattccatactgtactttttattaatgcaagtacaaattaaggaaacattattagccacacacaactcatgcttttatcttccatgttaattactattcctttacgattcaattcagtgagtaaatttttatagattatttgccatataaagtaatatatttctactccattaggataatggttggcaaagaaagtaaaatatggtggaatattctatcaacataagggttctgccccaaacagttaaacgcaatatttattttgtgcacttactttacaaatatcttctatcacttattttacacatattgagtaaactgcagtgggtttggggagtgaaagacaacaaaatacttttaaagtctgaacctaaatggtaaattatagctgtaatcttcaacatcatcttccgaaaaaaattttagtgctatattctttctagtttgaactccaaacttctcacaaattcctttatgcatggaatatgtactaatagtgcttccccaattgttttactttcaggcattatttttctttttctcagaattcctgaactctggatgatgctaataggttagtttttatctttttttgactgatttgccatctgatttggtgtttgatatatttctcttctctttttttcattgaaagcagcactcgtttagtttagtttagtttagtttagttttttaggttagtttagtgttgtttctgagatacagtgtctgttgccccggctggagtgcagtggcacaatcccggctcactgcaaactccgtttctcaggctcaagcagtcctcttacatcagcccctctagtcgctgagactgcacgttcccgccaggatgcctggctaatttttttacatttatttggtaaagacagggtttccccatcttatccaggctgttcttgaactcctgggctcaagcaatcctctcgtctcagcctcctaaactgttgggattataggcgtgagccatggcacctgccttttctcttaaagagtattctcttgttctcttgctttgaaggtgtatatggtcttttttttttcctctgagtgacctaatttttgccctaatcctttagttatgtgtttgtttctttccatatgtgaggtgttgacttagacaaatttactgtcatttcaatgtctactaaattcaatttcttccattggtcatgaaaaataatacatcttctgctaagtaggaccatgcttgatgttgtatttgaagtagattgagaataatcagtttttcatattttccaaatccacattttccttagagaaaaagcaaggagaatcaatatactgcagagtttttgtgaagtggagtccttggcttctccagacagtggcctgagtcaccatgaatgaagagcactcttgtgttaggtctactaagccctcaagattcacttttgtggatctgaaacataagtgtttttctttagtaaaatgaaaaagctaaaaaaaagcttttatacttacagattttgcttcagtaaatgtgtatcttgaaattgagaatttgacagggctggataatctagctcgcatcttcaggtaatttcaaattagaagttttaattgtatgagccttgtactttaaacattcttgtttcaaatatattttaaaatcaaatgctttggtaactggggtcaaaggctgagtaataacagtttatgaagtcaaagccagttctcttttttgaagtagaatcctgaaaatcattgtatgtgtgtgtgtgtgtgtttaatttttaaggaacaagatgataatccatatgtaatcctgacatatacttaaaactacagaataagggtaaatcagttatattattttgagcaaacaaaatataacagaataaaatataaaacgtatatgctctgtttttcagtattcatattttcagcacagttgaaacaaaagatgtcaatataaaaagttttttcttaggctttgtaactagtccctccgttaattagagaacaaaatgtacaacatctcatgtatttttggcttggtagttgttactaatatgctatattttctgaatttatgtaaaattgttcttagtaaatggattaccttttctggttactggcagaaccaattgaagttgatgacagattttcttaatgaagtcattgatgaaaattgcatactaggaaatttccaataaatctattgaaagtgcttattttaaatgactaaaaattttatatatttttaaaatgtcttaagtgtctttggattttggaattctcacaaatgttactgtggaaatgctattctgattggattatattaaataaatttattatagggcaaaccaacatgaagttgaataaagcagagggggaattaaccaactgatgatgtttttttccctgtatggaaaagttgaaaagcttaaccctctagagtagcttacacatctcagctggagaattggaaaaataaactaaaaataaaatctaagccctcctattcactgaacaaactgccttgtggccaaggggaccccagaaaagccttaaaactgaattctcagcaataatgagatgggaggtcagacaagccccctaataccctcttcctttggcatttagacacaatgactggccctcattaatgttaaaatagagattataagactgacagaagatactctttgtaacaataagataccaaattataaacagggtgtgaggccatgccaggcaaaggttaagtcacacactcctacatttaaagaataaactatattctaactccttaaggcttctcttttcttttttttctttttctagaagctaaacaacactggcctcaaaataaacagtattaaaatgattacaactcactcagcttacaaaggctgactaattgaccctctgttctgccagccataattacagacaagaaactgattttggtaactctctccagataggaagaatacccaccatggattggttctggccgggtttacagaggctgacacttgggtgacttcgtgtcctgaaaaatccttttgacatatagggcctaattgtagtatatttaaatgttaagtctccactccaaggttaacatggatgtatgaggcatggatgtttcattcaaaatgcatgcctcaggaccaccatcatgaatatttatagctcctcttataacctgttgaatatgtatgtttagccaacctgttcagcataagcttctaccccaactcctgctccttcaaagtgtctgtcttcggtcttcaccggagacacacttcccagcctacagtttggccacctgtaggctgtaaaccttcacaagaaataaaatctcctttctcaatttataaattattatttttttaaagttaacaagaatcacacagatgacagtatagaattatctgactcctgaagggaagcagagatcctgtatggtcagtaaatctacaacatgggatttaaatcagcactattgatcatctaaagatcagcagcagtcataaatttgtcaaatactctttctatcaaatatccttcaaaaaatttgtaattaattagacactagcaccaaaattgttctatttgtgtcttctaagacaatttgtaataacaacaacaacaaacaaattaataggtctcctctttttgtggagagtttccagagaaactgatatatagcgtggtattgtaaattaatatagtcttttcagaaagttacttgtggcaatacaaagaagtcatattcttatactagctattgtttctgagttttcttaaagagttaattaaacagaagaaaacagaaatctacatgaagatattcttatcaatgctatctataaggtcagagattaatgtttaattcaaaattaatgttttgaatatctaattatatagattagctttgtaaatgatgttatgtcagtattattattatcataattatcactattattctgattcattcatttaaagggatgataactgtttacaagcatggaaaaatatttatggtataatcctaggtagaaaaaaggagaatgcaagttatattgattcattattttgacaaatatttattatgtctaccatgtggctagtcacacatttttttaaaaaaagtggtaggcaaaatgtatgaaatccctaactttatggagcttttacacttgtggtggatgcatatgtaaaaaaagtgaccacactgagttaatccattacaagagaactgagtggtactgaggaaagagacaggacctctggagtggatataacaggagaatctaaatgagcctaggatgaaaaaaacttcgtgggaaaggtgcctggagaatgaataggagttattcagatgaagaagtatggaaagtgttccaagtagaagaaaagtcatgggcaaaggccctgtaaaagttataacttcaggaattttgagggtcagaagaatgccaaaatgactgtataatagacagtcagggaggactgctgttaccccaggtaaagctagatcaagcaagatcttttacgtaacatgttaggagattagtatctaaataatagtggcaatggaagtatcttaagcaagtatatgcattatgattctacctctgtaaaacaataaatgaatatatatatagactatatatatagtctatatatatatagtctctctatatatatatatatatagtctctctctctgtatatagtctctctctctatatatacacatagtcaaggggttgaagtgaaattagcaatgactctaaaggcaaaggcagaatttgggttaatttctttttataagagaaaactaaattattatatatgatgccacatcaactcttcaattacatttatatttgaatgaaaaaatctggttttctaaacgcatattaagtaattttaaagttctttaatgtcatttttaggacattaaacattatgagaaattctaacaaataacggtttctaaaaaataattcctaagccttatagtcgatttcttcagttgtaataaaacgtttctctaaaaagtatgtatttgtgtttttaatgtaaagtataagcatgaaagatttgaaaagtctaaaggaactttgagatcaaagctttgtttataggatttataatactcagttgaggataagaattacagttacattactatggtactattgtacagttgtacatactaatattaatttatatgatgataactatgaaaatgtataactattatgccgttatatgtactactgtgaatttgagctatgcagactgcagtgagactattttttgttacattgtattctcttaaaaatttaaagatgctaaagatatttttcatgtatatgaaatgaattatttttatttcattttaaaatataagcagtagaacactttgctttaacaaatactaatttattttatgaatttaataaaatgttaaagtaacttttatagtttttaaaccatagaaagtttctggcattttagggagactaattttctctatatatttaaagcaatggtgttgtcacatcgcacaagaaattttattacacaggtataaaaatataaatgcatcagtaaactaacctaaaagttaatggcataagaaaatgaggatgggaatttgtgtagtgtctatcaagcatttgtcaggatttcataatcaaataagaaatgttgctatttgtggctatgcaaataacatcatatctcactatcctgttgtatttgcaaaatgatatcagtgttgtacatgtatacataatacaagactatggaacaagaatttggctcattatgtttgaagttatataaattcagatttcatttctcagttttccagagagatgacaaatatgcctagcaatcctctatttaattattttagagaaagagattttaaaaaatattttaaacaaaagtactaaagattacttttcctgcactgtagatatgtgcttgattcccttgattagtgagaattatttgtgcatgttaaaggaagtctataacctaagccttaatttcaaacctttcctaaaaacactttttgaaagcttaactagagtggctacatgcttttcacccacgcttatgttcaaacactttcaaggggaccgcacttactttaaaaacctaaaatcacagaagcatgttacattagccaagttcaataaaagacaaccacaaatggaatgcaaaatatcttttcgatctttctgtaatcacttcaatagtaagacagccacctggggctgaatgtgtatcaccagtcatttcaataatgcaattatttgaaaaatataactactggaaaatgctgttggcataaaatgccaaatatgtatgtacatgtgtatactgtgcaagtatacatatgtatataagtagaattcagaatctcaatacctgtgggagcaagtaagtataagctaaatacaatagaaaaaatgaagactgaagtgcatatcatctatgcattattcatacttgaaaaatcttataatcaggaataatagttattgaagtgagattcaggtttatggcaacatttagctctctgtagataaaatctctatcacctttagagggtggatgacatttcaatatcccctaaatggtgctatgtaatctcgcctctctcttcctcatttctagtggtttacttcccccccacccttttttttgtttttacattaaatgcaatgagacgtacttaatgtccttgtaggctcatctttctctacagagacagttggaaaatgccatgagtatcttgggaaataccaatagtggcagacagcattgcccccttccttattcacattttcagggaagcttgatactgattagccagaagttatatattaaagcatctattatatgcctcttattgtgctcaccactgagaacaatagaaataagaaaaatggtttctactatatgctatttatttttagcaaatgaatgtgcataaaataatgaccaacgaagtattaactgggtaataaaaaggacacatacaataaaagtttgacaattagggagacgattgtgggttatagtagccatgaaataattaatgaactagatgtgtcctctgaaatagttaggaggaaacagagtgagtaaaggaaggaagatggcattggtgagtgacaatggagtgataagtcttttgaaacaaagcttatattggggagcaccatattataggaaacaaaaagaaaggtagaggcttgaattgcaagggtgtttgggggaaaattggaagccagtgaaattctagtgaggtagtgattactaagtgttttcctatcattaatctaggagtgtaagagaaaatataactgaagctggaaacaaaaaataaataaataaagagaccaccataataatcttggcatgaaacagtgagatcctggcctcaggtggaattaatggaaattgccaaaataagggaaaaatataaccttgattaacaggaacaaaattgtttgcctacgtgttcaggtcatactaagcaaaataaacttgttccttattttatttttaaactctaattttgattcagaaacatgaggatataaatccatagcagttttttgaaaaaaatgtcaagaacaaatctttaagaattatcaagagtgacttaagcaatattgatgtagagataatattgtcacaaaatctaactgtggtgcaacgtttgcttttctgcctgagctgattattaggcataaacaatcaagagcaagtccttttggttaaaggtgattttgggggattttttgtgtggatgctaaaaaaattatattcaaggatggaaactctttaggtaagatagaagaaatattacagaataaaaaaattaaagcataaaaaagaatgcaaacatgaaaaggaaaaggagaagtagagcattaaagccaggaaaacgatgtagtttttactaaaatttggagatttggagtattgtgagaatttagaacagaaagagaagtgaactagtagaaaaactagatgtatccttgtctgtattcaagaaacttgggtgaacaagggtaaaatcaactgctcattagtgaattaagattcctgcactagttgatttctaattgtctcattttaattaagattttacactgcaagaaactgagatgcatgcaggttagttcagttaatggattgaaaataacgaaacaaaacagaaacatttccaggaaagcaagagagactggaaaagtctcaaaagacctatagtaagtctcatgaggaaaggaaaaatcactcattcaccttttaaaatacaatagaaatcttagcagtccaaagcatgctgtcacctctaaaaccttttagtgggttgataagattgtgagttctctatatctgcttctgtgtctaccttttgcacctgattatcaactaacttctgtaagtattttttctaggtgaggaactctgcctaatcacacatctactcttatagtttcaattccctgatgattgatttttgtgtatttttattaatatcctggtgtgtcgtcccttctctggcctcacgttctgctctggcttcttcttttggtattccttaaatggttttgtcagtaatcaaaaaggacacctgttaaatctggtgtacctcacaagtcaataggtagtgtacgggtatgaattcttattattgtgatctgagtagagggactatgttctccagagcatggcaaacaatctgtgttaactcttcaacagaggtttgcgagcatgacatgcaacatgacatttattaaaaataagtaaaataaaaaattgtagttacaatgaacaaggccatgatacaatctgtttcatatgggctctcttgatttttttttcaaaatgaaaagcaataaaaatcatcattaattaggcatttataattttttagacagtatgttaaatgcttcaatgtataccatctgcaatttttatagcaacccatgctaatttattttactcgtgccatataagaaatgcagaaatagtttcagagttgttctctgaggtgcccaaggcaaaataattgatattagatagctgagatttgacaaaccatgtctctgactctaaaggtctactatctcatttctcttccaaccgccccccggccttcatctttccttttttttattatggttttaaagatgttaaaatctattacctaccctaaggaaataatgtgacgtttggtgacaagaaagctactaagatttatggaggtagttgggggtaaccaggcattataaatcatctttgaacccactcctggaaatagcggacaacctaacagaattcatctgttttactgtttagtgacacccctattttatggagaaaatgatacagtcagaagacctcatggatatttttggtagtaatctcaaagatgtgggtaacagctggcatttcggtaccatttctttgggtaccagttgacgaaggaagagtggtacatacatttagcacatatctcattcttttaagataaagataaggttgttaatgaatatatttaaaaaaataaagacaggagacaaagctgagtatgacaatgtggagataatgatattttatggataaaaaaggttcactgagattaagaacaaactgattcaggagtggaaaaaggtggaggaaaaattcaagaagacttgttaatcaattaggtcatatacttaagatttggggtagaactaaggataatttaatgatacaatactaatttaaatgacacaataccttatattcagatattttataaaacaatattaatagaatagactagaagaatagtattttcatttgtatgaaaataagatgttaaggcttcaattgattatagagaacattaactgttgttttaaggtaaatacaactctaagtagtgttaattaatctaggtcactataaataatggtcccaatcttctcagtgacaaagtcatcttagaataattcattgtaagtttcttatttcaaaggggaatataaatgagatgtcaagagttctgaaaagaatacattagaaggaagatcgaagaaattcaagatgtttgttctggggaagaagacaagtaagtgatatggtaggaagacagagcacttgtcttctaacacttatttattgaacatctatctaccttgtgataggatttaatgaacaaggcagccaacatcctgaattgattaaggtccaccatgatctcattttaacttaattgcttctttaaactttctatctccaaaagcactcacattctgagaaccgaggtttaggatttcaacgtatgaattttggggtgacacaattcagcccataacagtagccacatgaagaatttgcaataatattccagaaagtaagaacatccccgagaaatgaatatgcttgatatgtcaaagaatagcataaaggctgctctggcccaactatagcaggaaaaatgacagataatgcaattgaattgatggtcagggcccagatcacattgggccttagaggaaagagccagcatttcactttcttctcgatgggaagcaagcataggggtagaagtcgggcataatctgacttatgcattaacgggcactctgacttctctatgaacaataaagtataggcgaaagtattatcagtcagaagttgctgcagtaagtaatccagatagaaaaagatgcaaagatactggctcggactaagcagctgtaaatttggtgagaagtggccagattagagatttttttttaaggtaaaaccaacaagacatatgttagattagatgtcaaatagaaagctaatggaagaattaagagtaattattcactttgcctcagttcttaaattggaaaacagaagaaataccctagattactgtagaaaatttaataaggactggtatggaactcatttacaagtagatctaatcacagtttaggaaaaaatttttaactcaaattgtccagtattggagtgaattacctcatgggaaaataagtatctgtcagtcaagttgagcaagatgggggatgggatgtaatccaattgtattcattgttaataagtatggttgaaagaaatctctccagaggtaatactcacgataacatacaggatgatttcactattataagctattgacatcaatactttagggaccattttcaatggataaatatcaatgcaattgaacagcagaagatcaaaattttaatttgtatataacaggaaaatatttccattaaaacattgttaggtaaatttgtattttctatcagtgtgaggagagaaagtttatttgttggaataatattaatggtaaattatttattgagggttctgagacgctatatttgataatatcttattatactttaatcattgcttaaaaaaaagttgcactatgcaactgcataggttcagttaatttcacaagggaatgtttgttctactcaaaggtgtacctcacttctcctcatttccttcagaacaataaataagccagggcataagttatcttgagaacaaaataatagcatgggctaaagaagaaaaccaccttcatactgaaaaaattgcatgaccttgctaatacacactgaagtgaactaggaaaatatatgtgagagtgtatcagggattttgagcaggaaggagaatataagacaggacaagtgaaaatgtattatttgaaaaagcacttttccatttcttatgccataaggacatctggagctgctcttaatacaccactggaatgtttttttgaagcttatacctgatgatagactatggcaaattagaggagatgcataaactaccttgacaaaatgttaaggatagagtcagaaaatgcagagatataggaatgttagaatgaatttattatgtgaatgaagaaccatcatcactctaccaaatttctcaagggcataaataaaactcctttcaccaaaacattaagaactgcactggtaatgaggctattggcatcattgagaaggagagagtggctgatttctagaaactggggttaagagtaggagaagctgacattttcttactatcattagggccagtggaactccagaatgttcatggtcaagtagtactaattcatccaacagagataaagtagacttaatcaccataatgaacttcatggccaaaatggcagtcaaactgccttgaaatacaggaatctgtggtgatgactaatgggtcatgatgttcctagtggtaagagagacgaatagctgcctaaattgattttgacttgcataactagaaaaaaatcacaaactagaaaaaaggcagacaagtcaccaaaacagaaaactgcaatttttcacccaagttgtagatcaaagtaagtttgactaactaccttcaaataactagaagaaaatgttgcagaattattaccaggatacatgaataacattttctgattatttcccaaggggatcgaatgccatttcctagtgtagctggacactgggcaaaggaaaaaaatgcaactcttttatgagcctttgaaggagaaatagcctgaagaatgggtactcaagacttccaggaagtttgcaatgacttgtcctattgttcagggtccggcaaggaacaagatccaaatgttatagatgacaaaaaattctgggagggaggcattttggtagggatagaacacatggatctttgtattttatgttagtgcccattgaagagcaactgtttcagaagagctgcttagtaatgatgtggacaacatgaaacattctgtgaatgtcagccaatccttatccttgactatgcagtactgttgcaatggggccatgaaaagattagccacgggaacagagacatatgagagagaggatggccaataccaggggtttcttctcgtcaagccaatgctgaatgccaaaactgagccattttttattagtgaaaaatgatatgtttataaaccaagggcttgtgacattaaattagatatgtttctatattagattttttaaaaggatggtttatactgactttaaaaataaatagagatcactatgagctattgtaggtaataaaaatggaattatagcaaataaaatgcattgcttttatactgataaaattaacaaaacagtagatgaccagaaagcaatataattatgttatatgcatctggaaagagtattttcatgcttttcctaatattttatgtagattcaaaatgataatttattagtctaaaatggatgtataatttcaatagatgagtcattttcagtaacaaaattggatgcatcatattctaagagttgactgtgaaaaatgtggtgattatcacattaaaaaatcacattaacagtagaactcaagagagcctaatttatacaatgaaataatgttacatagttttaagtgatatgacaaaacttgagataaaacaagatttaaagtattaaataaaaattaagtaataatttttaataaaatgagcctaaaattatcttcttattttaatttttatatcagtatatatttatataacagttggagatgtggcctaagtatccagaggaaaagacccacttccagagcaaaattcctaagaagataagattataggtatattttatttactaacatctattactaaatttcatagacagcagttactctaaaccccatattctgagaggagtgacaaactcccgttttcattaagtatttttcttccttttttttctttttttcttgaaacagagtcttgctctgttgcagtgcagtggcgcgatctgcaacctccacctcctgggtttaagtgattcttctgcttcagcctccagagtagctgggattacaggcgtccgccacgatgcccggctaattttttgtatttttagtagagacagggtttcaccatgttgtccaggctggtctcaaactcctgacgtcaggtgatccaccagcctcggcctcccaaagtgctggaattacagcggtgagccactatgcccggccccctcccaccattcttttttttttttttttttttaatagaaataggagtcttgctatattgccacggctgaactcaaactcctaagtttaagcaatcctcccacctcagccttccatgtagctaggactacaggcatgccccactgcatctggcttttctttttaataatatattaaagtgaataaaactgggttccaggagtgtgtcaaaaggaaatgccatttgaataatgtcactatagtaatatttcctttatttggtggcatatcatgaattaaattgctcacattattcaaatcttattcaaaaaagatttgaacattgttttgctatgttttacaatgctaacaatttatacaagctcaactttcctgggcctcagtcttatgattaaatatgttacctttacagaaaaaaataggtaagaaacataggcaatatgtttgtaacaagagaaaaaaatatatatataaatataaagcagatcactttttaaattttattatttttattttattttattttttaattatactttaagttcgagggtacatgtgcacaatgggcagatttttcctgcctctgtagactccacctctgggggcagggcatagctgaacaaaaggcagcagaaacttctgcagacttaaacttcccagtctgacagctttgaagagagtagtggttctcccagcacgcagcttgagatctgagaacggacagactgcctcctcaagtgggtccctgacccctgagtagtctaactgggagacacctcccagtaggggctgactgacacctcatacagccaggtgcccctctgagacgaagcttccagaggaagaatcaggcagcaacatttgccgttctgcaatatttgctgttctgcagcctctgctggtgataccctgggaaacagggtctggagtggacctccagcaaactccaacagacttgcagctgaggatcctgactgttagaaggaaaactaacaaacagaaaggacatccacaccaaaatcccatccatacatcaccatcatcaaagaccaaaggtagataaaaccacaaagatggggagaaaccaaagcagaaaagctgaaaattctaaaaatcagagcgcctcttctcctccaaaggaacgcagctccttgccagcaatggaacaaagctggacagagaatgactttgacgagttgagagaaggctttagacgatcagtagtaacaaacttctccgagctaaaggaggatgtttgaacccattgcaaagaagctaaaaaccttgaaaagtagattagatgaatggctaactagaataaccagtgtagagaagaccttaaatgacctgatggacctgaaaaccatggcaagagaactacgtgacgcatgcacaagcttcagtagctgattcaatcaaatggaagaaagagtatcagtgattgaagatcaaatgaatgaaatgaagtgagaagaaaagtttagagaaaaaagagtaaaaagaaatgaacaaagcctccaagaaatatgggactatgtgaaaagaccaaatctacgtctgattggtgtacctgaaagtgatggggagaatggaaccaagttggaaaacactcttcaggatattattcaggagaacttccccaacctagcaaggcaggccaacattcaaattcaggaaatacagagaacaccacaaagatactcctcgagacaagcaactccaagacacataattgtcagattcaccaaagttgaaatgaaggaaaaaatgttaagggcagccagagataaaggtcaggttacccacaaaacgaaacccatcagactaacagtggatctctcggcagaaactccacaagccagaagagagtgggggccaatattcaacattcttaaagaatagaattttcaacccagaatttcatatccagccaaactaagcttcataagtgaaggagaaataaaatcctttacagacaagcaaatgctgagagattttgtcactaccagggcctgccttacaaaagctcctgaaggaagcactaaacatggaaaggaacaactggtactagccactgcaaaaacatgccaaaagcagatcactttttaaccccctgcatacatgtaaccaattgttcccatttaattaatgaaggcttccatagctttggaatagattttcccccaagggttatacaaatgattaattttaacaacatttcacaattgtgatcataacagctcaaaagaaaatgaataatgaacgtgaaacattaacacaagtatattctcttttaattatttgttgtctagttttattgaaattgctcagaaataactaaaaatttgaaaaataactatagtcatcaaactcgagctgctataattataaactgttgacatactatgtcattgttaaccattagaaaattaataccatgtttctgaaaagtcaatatatttgtaataacttagaaacttcattgtatataagttatgacacaaataattaaaagtactcattttaaaaatgtatgcctttttattagtaaaaatacatattccaccattcaggcactataaaaatgtgctctttttcggttattactttctttcaacatcctaacatgtaaaatctaatacatttgtgccactgttattattactgtcttctatattctaaagtatttttatgtggcaacatcacattttccttatacacttttagtataattacagctatgcaaaaagttattataattgtagtgcttaaaatttatatgacacttttcatcttatctaagttataactaaataggtaattaatctataacatctctaaagtggtgtgcaagcatttcatctacgttaattatacaaacgatgaaagtaaacattatactacatatatataaacactgcaagatgatctagtcagatggaaatggttctattaagcttcgaattaatctgctaggagatgctataaagtgcataaaagagggatcaacaaaacaataagcagaaacatatgaaaatacttgaaagttcttttaatgtgtgtgtatgtgtatatgttcgtgtgtgtgtgtatatatataagtatgcacaaaatgatagtattcttaatacatcatcaaaggtgatacaaattgtgtcaacacagataaatttttatttttacctatttctaagtaattaattataaaaagaaagggagaggcataacgcattgatagcggcattaaaatatatattggggaaagatggccagtaggatatcactgcttttggttgtatctagacaagccagtattagtcatgattaagtcattcattctacaaatatttaatgaacttctactctgtgctaggctctgctgtatgtgctgaatgcaaagtgccgaccctcccagaaattactttccagtggccactcaagatttctttgtgaatggtatttctcctttagccagctcataaaaatagcagctgaaaaagaaaagttgtagaatccataaataactgtcaaagtttagtcagagatgattgcagtgtcctgagagatttgacagtgtaagtgctgggagtgatttgaaacaaaaagtatatgattactgttattaagagtgtttttcatgggagattgtatcagatgcatgatggtaggctcaactatggaaaaaaatattatccttagtttttgggcttcagatatattcataatcatctgaatgtagtttgagcacagagaatctatgacttcagccttttttatcttacacatgtaataccaaatcttcaactatatttgctatactggaggattgttagaattaataataatgacaagaatatctaacatttattactgagtgcttggtatgtactagctactgttttaagacatttcatgaattatctaattggatgttcatatttctttgaaattccagtgtgaagtttttctttgtctgtaaatgtctttatagtaaaaacgatttgagtcctggacgtggcatccttggttcagttttcattcaattattccagcaactcattatcttgttatatatttgatgcatttaagaattttttgaaatgcctcaatcaggttattttataaaatacggacgaaggataggctttagtttctattatgaaattactagaaagtcccttgtatgtgcattttacttatttaattcaactatgaaatgagatgtaggaaaaaaatagtcccattgttatccttaaatttcatttttaatcattccccaaatgattctacgactccaccgataggacaaaaccaaagtaaaataagccaaaagaaatagatggtgaacctttttacagttcctggagatatgagagtgatttaagaatttttcaaagataacacggactgtatacacttcaaaattatgagttaatttaaaaatacaacctctgaattacatgcaatcttactacactacctgtgtcattagcatctgcttctctcaaaaacagatttgcattctccaaactcacttgcctatcatgtatacttaaaactaaagttataataagctgtaaaaatattaatgataatttactagtaggatagattacttaaaaacatgtcaagtgttacgctgagtgcagaacagaacaagaaaacacagaataatggaaagatataacaatactgtaagttagtgaaagatacatttcgcattctaagaattttaaggaacctttgataaaagtggaaatattgggaaaagtgtaaagtatgaggttttgtttgttggttggtttggtaagtcccatcctggtaaagctcacaaaacatcctaatttgtagagcaagtgctaatgatcagtggagcagatgtggctcataaaatttcggctgaaaatgactataatcatcagtcttagaaaatagcagcattcagaggtctctgtggtcttataccagataggctattcagagaggtggaagaggttgcttcaggtactaggatgtagttttgggagacttatagtttctacctggcacagagacagggtcatacagtaaatctggtgcattccttttagtgctataattttaccaagcatggagaagacataatgctgaaataaatttccctgtagaggtgagggcatatttctgggtctgtccccagtctcttgtcattgataatatttgtatcagttctaaaaaccaggaaaagatggtatccacattctacatacttgaaggaatataggacgctacaaaagtgagtggaaatgtgaccagaatgaagaaagagctcacacagcctgtaactcacctgtttgtatctgacaactgctcttatcaggaaagttggccagattctgactaaacctcaataactatcttatttggaaggatgaaggcgggatctgacagtgttccagtgtgtgtatagagaagagttgtggaagcaatgtgtttggttataaatctgaatctcaccaacacctgtggaacacacatcagctattggagatcatatcaagcagggattactccatgtacactagacatatatactgtacctatcaaagagaactagcattttacttatagtagttccaggctgctacatcccacacagggaaaaaaggtatagcaaaaagtaaatgctcactgtttatggtgcctttgggtctcattcatttttatattactgcatctctgaactgatgtggttcagccaagtaaaataaccattcccattttttcccttcttgactcatataatgttacagatcatctcaagacatcagatgacccaataacaaagatgaaaataaacaacaaataagaatggcaaacagtaaaactactagacatatgaaaacaaagagactacgttatagaaaaagaatagtttcctttcaatgaaatagaattattacaataaacaggagggcattttagaaaatgtctaatttttttgaaaatataattggagaggacaaaataccaagaaatctagagcaagttgtatgtgataaactaaaatcttgaaatgtgaaaggtttaatggagacagaaaaagtaatatcaaattttaaaatgataataaccccaaaaggaagcaatgagtgacagctgcataaactaaaaaagacattttatatgagtctgaaaatttctattggaaatcagaattttttttcatttattcactaaaagaaaatgtcttccacataaaaataaaagaaaaaaaatgagaaaatcaagttaaaaatcagaaaatattatgtaacacacaagattgaatctactagttattagtatacaggaatcagttaaaattacctatgaaaagacaaggatttccagatttgattgcaaaacaaaattaactatatgtcatttattaaagacaaagcagaataaaaattgtttaaaaattaacttcaaacaaagcctacttaaaatgctatatgtaactgtagtattaatatttaatattgaataaagatgactttaaaaataaagtgtctcatattactaataaagaatatatatgtatataaaatgaattataagccattagagcacagcagataatattaaaaataaaaagagaatttaacaaaagtataagtatagtggaagactccagtgcataacttattagtccttaagacatcaacaaagaatacagactatcttaattacacaattaaaaaagccagtttaaccgttgtactaaatttggcatggaacacaccaagaataaacatattttccaaaaactattgcaccaagtcaaatatagaaataagatatctcagtttctgacattgtgataaaactggataatacaagttttaacaaacaaaaacttcaaatactgataaatgtatatcaaaaatcactatcttaaataattcatttaaagataaactcaaaactatgatatgcagaccagttaaaaataatagcagatatatacagtcatgtgcagcttaacaacaggaatatgttctgagaaaatgcattgttaggcaattttgtcgttgtgtgaatgccatggagtgtactaacatgaatctagatgtatagcccaggggtccccaaactttttggcacctgggaccggttttggggaagacaatttttcaatggacggataggggtgggcagtggtgcagtataaagcggggatggtttcaggatgaaactgttccacctcagattatcaggcattaagtagattcttacatggaacacacaacctagatccctcacatgtgcagttcacaatagggttcacactcctgtgagaatctaatgctgcagctggtctgacaggaggtggagcagtaatgcttactagctggcggctcaccacctgctgtgtgacccagttccaaacaggccactgatgggtacagatcagcggcacaggggttagggacccctggtatagcccactacatacctaggctatatggtgtagcctattgctcctaggctacaaacctgtacagtatgttactgtactaaatagtgtagacagttttaacacagtggtaagtatttgtgtattcaaacatacctaaacacagaaaaggtacaataaaagtatgatataaaaattaaaaatggctcagctgtttgggcacttatcataaattaacttagtaggactggaagttgctctgagtgactagtgagtaaatgtgaaggcctaggatattactgtccactactgcagacttcataagtgctatacacttaggctatgctatatttataaaaaataatattctttcttcaataatagataattacttcaacttatcttataaacattttaattgtttttaattttttggctcttttataatgacacttagctgaaaacacaaccacattatgcagctttacaaaaatattttctttatattcttattctataagcttttttatatttttaattttttaacatttttgctctgtaaacattttgttaaaatctaagacaaagacacacagattagcctagtatgaaacagggtcaggatcatctacgcagtgttttccagctccacatcttgtcccctggaaggtctttggggcagtaacacaagtggagcggtcatctcctatgggaacaattccttcttttcttttctaatacctcctgaaggatattccagagactgtttcacagttagctttttaaaaaaataagtagtacactctaaaataatgcttaaaagtatagtatagtaaatacataaaccagtaacacaatcgttctttagcattatcaagtattctgcactgtacataattctgtgctatattttcaaatgacaggcagtgcaatatatttgtttccaccattatcatagccaacacatgaggaatgcttgtcgttctgacagctaagacttcattaggcgacaggaatttctgagttccattataatcttatgggatcactttcatacatgccgtcctttgttgactgaaatattatgcaacacatgataatatggcttggctctgtgtccccacccaaacctcaccttgaattgtactcccataattcctatgtgttgtgggagggacctggtgggaaataatttgaatcatgggggcagttttccccataccgttctcatggtagtgaataaatcacacgagatctgatgggttcatcaggggtttctgcttttgcatcttcctcattttctctggctgccaccaagcaagaagtgcctttcacctcctgccatgattctgaggactccccagccatgtggaactgtaagtcccattaaacctctttttcttcccagtcacgggtatgtctttatcaccagtgagaaaacagactaataggcatgactatatatatcaaaatacgtggatctgtgttcaaagaataagtgataaagaaggaaaatgcagctcaataagctacagaagaccaaaataacacaatattttcttcaaaatatgagccagagtttagtacttctgctgcatttaataaagtattatgggtttttttcaatgttatatttttagaatttttatagattcaggtcttaggtttaagcccttaatccatcttgagttgatttttgtataggtgagagatgaggaaccagtttcattctcctacatgtggctagccaattactcaacaccatttttgaaaagggtgtcctttccccactttggctttttgtttgctttgtcgaagatcagtcggctgtaagtatttgggtttacttctaggttctctattatgttccattggtctatgtgcctacattcacctctgagcaagaggtgaatgggatatgctgactgactttggtgcagaataattaaggaatcagagagactgaggggttgaggaggaattatttaattatttaggtgcactgacccagtcggattaacatccaaaggactgagccccgaacaaagagtcaagctaccttttaagcatttcgtggggtggggggagatctgtgcagggggaagcatattacagaagtgagaaacaaagacagttattcaattaagacatgcattacattatttattacttttcaaggaacaacatgttttacaacttgagattatctgtctagtgaccttgcagctgcacagctagagaaacagtcttcacaatgcctgggaaagggagaaataaggctcactagccacagagagaaaaacagagagttaattttaaaggactccagcctttttctcttcctcacggggaactgggtttgcttacatacaactgagtttttgcttacacaatctttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacacgcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacaatctttaacttcttttaattcctgttccaactttagcaaatcagtctacccctacaacataaagcacatgcactgtgtgaaaaatgcctgagacactctggaattgggatacttttactaagagatagagagcattaactctgaggagtgatgaaagttggttatgtaggatttaagttgaagtttttaaacaagtatctatgattgcctatactgatggaattatgttccctgaaaagcagataaatgattttgttttatttttacagcccaaaggatagctgacacatgagcctgtgggtttttaaacaaataattttcatcaaaaatataaacatttaaatttagtcttataaaagatgcatttctttgacaatgttggttagtactgactaataaacattaaagattgttatcacaaaaatgaaaataccccacataaatccatattgaatatgaaatataagaaatgtgagaatgattatttccatgccaaatgtaataaaatggctcacaatacaattttagaaggataagcaacatacgttttggaattctgattttttagggtaactatatctaggaaaaataatatctgtattttataaaaagtagataatataaggcaatgctttcctaactcaatacaaatggctgacttgaacatgatatctgaataagaaaattctctagtgttgcttttcttctttattgagaaagctgatacaaattcatatgtacaaagagtaaatataagattaaaatattaatttagactccagtagaagtaatgttttcaatgattttttttctgaaataggtatgagcttataataatacatccattacataatcttaaaaatttatgttggtatctggattcaatatttattttaaatttataaattttcagtaaacctggtcaaaatattcctcacctgaattaaacttaccactgagctaaaaccatattgtatttagtttgaatatatgctgatgcacaatactacctaaccattataattatttttactctcaccaccatcaccatcatatctctattatcattattattactagtactatttctactataatgttgactacctttgctgaaactattaaaactgttattatataataactaattcatactttgttagttcatcagtgatagaactatagtgaaaacatctctcaagttttccagaccttaacgttgaaaagcacagcatttgaaatagacagatcatgccaattactagccatacggctttggacaagtaatttattctctctgaacctcagttaattcctccataaaatgtgataataatatctatctcttagtctattgaaaaatagtacaataatgtatatagaatacatggatctagaagctgatagtacatataatattctggggatcaataaatactaattcatttctgatccaggcaaatgacccttatctttctgtccttgttttaagatgttcttcatagggtgagttttctattgctctcaaaatttcatatactcatatttggacattctctaggtccattacatatttcttgaagtacaaggttctgaataatagctgatacacatgatctacaaaggggtattttgcaataattaaaagttatgctgaatttggcatttattcttttattttgtataaattttttatttcaatagacattatttttcattgtcttgagaaaaatgtgctaaaatattttaatgaatttttactggctttatgtcattagtcagactttgatgtttatcttacgagacccttaattcttttatgataatttactgataatcaagatagtagtatcaaagtaaggaggtgatttataaaaactggtttttttttcagcctgcacaatacaaccgttaagaaaatcttctatttaatttgtaaaaataagctgcttaggctgtatattatataactaaagtcttggctacattattatagcagccataattaatagtcttcctcaaatataaactattgtgtggcccatttaattcaattgtaagaatcaaactgactagtacatttttaaaacgagaatagataacactaaaggcagtaaaattataaatgacacaagtgattaaaatgaaaaattccataaatttttttgatggtaagaatttagtctctctctggacagctttcaacaccaagcttttttaggatctaccagtctggggaagtttgtacatatttattctcatgctgaaattaaaaacaaaaatctctttgtcttgaaattaacatgaatgtattcaatgagtactcaataaatactttctgattatctgtctgaaacatttgaaatattttctttatttgtaagcaaatataatatgtgacttataacagaatggaatgagcagttacataccaaggagaatatgaactttcctttttcaatataaattgattctaaaattcaacagtgtttagacgattctctttttttttgcctgaatttttctattgagcttatgacttagaataattcttcctttcatcacttcttccacaatcttatgaaattataaaacaattacactacctgtagaaactttcttgtaattaaaacacaagtgaaaaactgacggctgggcgcggtggctcacgcctgtaatcccagcactttgggatgccaaggagggcagatcatgaggtcaggagatcgagactatcctggctaacacgatgaaaccccgtctctactaaacatacaaaaattagctgggcatggtggcggatgcctgtagtcccagctactcgggaggctgaggcaggagaatggcgtgaaccctggaggcggagcttgctgtgagcagagatcgcgccactgcactccagcctgggctacagagcgagactccgtctcaaaaaaaaaaaaaaaaaaaaaagaaaaaagaaaaactgacagtagggttaaatgttattatttctcaaaaggatcccaaattgatatgtcaaattaaatcaaagtacaaatttacttctaaacatggcatcattcattttttcatcatattgatggattcagtttctttaccgagtctatatattttctcagttcagaaacaaagtgacttgttctttatattactctccttgggagaaacatctgctaagtatttgagacttaagtattttcctgtgtctagaagaagtacctttgttattgctttgtttcatacctatatttgcataattttgttcaagagaagtatactttcttttccaattactacctattagaaaaataagcagataaaatgtacttagaaagcacatgttaagtaatttgctcatttatatttgattagattgctctttaattgtatctgggaaggtttagagcgtagagagtgggaaacaaatacttaagcattgcagtagcctgccacccatcaaaagcacttcacttcttaaatgtcagtatccttatttgtaaatgacgactttgttacttgtcttgccttataagcttttggaagcattttagagtaaatgagttttttgataaagcactgcaaatttaagatcagtttgataattttctctaatttaaaatgtacaataaaagatggacagcttatcttttatgaagattccttaaaagctctaaatacaatcagggttacttcactggattaataacagaattaagtcagtatttattgcactaacttcctacacttattataatgcaggttattacctgtggtaacttcttttctaataaatggattcaaaatccttatatgtaaagatccaaggagctgcaatttacaatgaaaaacagtttgatgcttaataaatctcctttaataagcattcagttaagtaaaagtgttaaaattttggtaaaaatatctgtaagaatttattcatgactttgcaatagaccttttggatgacacatattcaattagggaaaaacaagatgaaacaaaaacaaagtaatcatctcattccatggagaacttagaaatatgcaatttagttgctaaatttaggttttatttcaaacttaggagattttattcctaattttacgtcactataacaataactaaaaatactaaaaagttcaaatgctacgtttgcattttttatttttcttgaattcaagaagaaaaaacagcatataattaatcacattatttctagttatgtgttttacaattctatgttactcataaatcgtgaccatttttgttttcagttatgatagccacttagttagactcaaataatgttttctaatagtcttgtctaaataattcacaaacaggatccacaagttccaaaatgtaatattttatttgattaaccagtaatttttagtcctcatttttgcttggacataactttgtcaagaatattataggactatatacatttcttactatctatattcacttcaaaattttagctaatatagatttcaagttcttgtttcttgcagaatctcccaccccaaacccattataaaaaggtttgtttggaaaaagaaatatttttttgatatggtgtggtttttgttgtaagtagggtttataaatttaaggaccacccttcatccaccagtttttaatttaatcatgggtttcttgtgcctgatagcagcataacccatttttctattttttttcctttgtcaccctcactaatgaaaccagtaatagtcctgaaccccatgccgttttgtcatgtagttacagcttgtccttttataaaagaaaattagaaaactgctgagtgttatagatattaatggttgttagaaaagcataataaaagcctctctttctggagcactgctaagcttttatgtcattattcatgagtgactaatgcattcaaagaagagtgccgatctctaaggctgggatgatgaacagtggagagggacagaatggctaagagaaagtcgtttgtcaaatgtgaagatttaataacaggcttgcctacaataagatatttcagctgaacttagaaaaagaaacttttcttacatatgaggtattattcatggtatttcaaatcaccaggaacaaatctataggatacctttgtttaaatgaatatttttcaggaacacacacaacccccaaatccagaaagtaagcgtcttatgaaatgccattgaactatacctgttttatttcttttatcataccatatcacatatatattgctcaatttgtgggtagttaaaagaatcataaatagagcatctggatttgttggtgttctttgactgtaagcaatgaaaaccaactcagggtttatataaaacatgagtttattagaaggatatagagtagcttttgaaatcctaggaaagtctgaagatcaaggaggacaggatcaaagacgtttctagaagtatggtaggaggaactaatggacagtctcatgagggtaatgccattagtaaaaatcacctcccaacatttttgttttaaacgtttttcagttcaaatttcaaattccaaagacagacagccatatgactatcaggggagagtatgtgcgtgatcttatttgtaaggtttcaggcaaaggctggatggtgtaattacgcaagcaaatattgaggttgtattacttaaaaaagtaagggggggcagacaagataaacgctgggaagataaaaggatagttatgaactatacctgccttctggatatctctcaggcctatttattttctttttccgcaacaaacacaaaattatagtgaccatttacatagtgtcctaaactacatgctttcctgtgacactgattagaatctgtcccttagagaatgtcagcatcatctttgatttagcagcatcttaatgttgtatagaagtgtaacaacttataactgcaggataaaatatgtttttcagattaaggtgatcaataacctctaattccaaacacattattgctaaattacgatgcatgtgaaatctggatacaagttaactactgattaattcattgtgactcgcttggcttagggatacagtttaaacatggaaagataagagaagaaaataattttgttcatttggactaaaactgtagttttggtttcttcagaacaactcaagaatttatattattactggagaattagttttgcttcattttctcatagattagtaatacataaagggaatttgattttgcaaacattattgtttaaaacatcaataaatatatccataaaataatcactctattagtctgttagatagatcagtcatccattaattcaattaagaattattgagtcttttatgttctaagaagtgttctaaaaacaggggctctatttggtgggaaaaacaaaatgaaacaaaataaaactctgtctttatgtagctcacattctactggaaatatacaagataaatatacccatgaatatataataaaatgccagctagttgcatgtgctatgaagaaaaaagaaagcatggagatggagaataatggaggtgggggtggtgacgtggaggacaaatattttagatagagtggttaggaagggcatctataagtgtgtcctttgaataggaatgacaataagattagacaagcagttacatcacgaagacgttatgcaatgtgaaagagttggtcaattaacatctgatagggtttcgttattctttaagtgttatattactcaagatcccatcagttatttcttttcctaccctgcaaacatttcctacattctcttatccactcatatctttgtttttttgtttttgttttttctttttttgagatggagttttgctcttgtcatccggtccggcatgcaatagcgtgatctcagctcactgcaacctccgcctcccaggttcaagtgatttcctgcctcagcctcccaagtagctggaattacaggcacacactaccacgcctggctaatttttgtatttttagtagagacgaggtttcaccatgttggccaggctggtctcgaactcctaaccttgtgatccgcccacatcggcctcccaaagtgctgggattacaggcatgagccgcgcgcctggctcactcatatttttgactataaaaatatgataagattattatatgcgaaatcctatctggtgtcctgagctccattacagacttcagacttcaactgtttagtgtctgtcaggataccagaatgtcccagagtcaccttatatacattctttccaagtcgaaatgaattattttcagcatcccattcatattcctttcttaactctgtaaccacatatagaaacctacagccattcttgactactttttcctcatggaaacataagactcaatttattttgcatcttaaatatttcataaataaaaaagctgcttctgttcattctgactaccctcatcctttatcattgattacttgcacttttgcaacagcttcccatatattttcctaggcttcaattaaatatcctcatctgtccttctactgaccttactgagataattgtatatatgactttgtcaggctccttcttaaaaccattcagtgactgttattgcctaaagtccaagctccttataaaacattacttcttatataatcagtcctaagtttaaacaagccctttgattaaatctaataaattcttatcagttctttactcaccttatacgctcaagaaaagtatttaacaaaatcgaccatgtctaggaactctctttggattctgtgatgccatattttgcagacatttgtaggtgctatggccagattccttccgattacttttatcatatctgcatacctatactcccctcctatgaaacttgcttctaacttcctgcatttgcagttaaattttaaggactgcatacagacaactgtgacccttttgcagagaacagacagtacgtgggagccaataaccacatggagctgacttcggcaaataccctatgagagtataaaagttcagctcatttgcatggagttgggaaaaattctgaggagcattttacccttcaggtcttgcctaaggaagcaggctacagttgggattttcccaataatcacacacttacatggtttcttcctcttccctactcccttaccagtttctccagaaatacttttctaataaatcaccagaatgtgaatcacgttctgaaaggcctgcttctgaagacatgattaaatactccactctatcctgtttcctttatcctgcttggctcctcttccttgctttccgctaccagcttttccttcttcatccaacatacaaattcctgagttcctcagcactcaaactcagactcatttctcattgcactctataccccctccttaggcaattttgcccatacctatgactaatgttacaatcattttttttttttcactaccctagacttttcttctcagggttagacaatatacctaactgcctcctcaggattcccacttggatatcaggcaactcaaactcaatgtatctcaatgatctagctcaacaaacattgtatataacatatatatatatttccatatatatccatatatatatttccatatatatatcatgtatatatttccatagatatatcatgtatatatttccatagatatatcatgtatatatttccatagatatatcatatatatatttccatatatatatttccatagatatatcatatatatatttccatagatatatcatatatatatttccatatatatcatatatatttccatatatatatttccatatatatccatatatatataaaatacaaatcatctctatattaggtactcacactatggaggaaaattaacaagagaactgctggcttaagcgggcattcagacttggaggaggaaggtagaaagttcttttggactagtgtcaggaagagaggaactttccttataaattagcagccacagacagcctgccttgtatcaagaggggtggagaggaacagttagacaataatatcctgtgcaagaggatgtggggaggaacagctggaagatcacgtgtgaaaggccacaatggaaaatgctgtgtccttcagagtctctcccaacatcatcttcctgggtcctcatgacttccctccatcttgtttgcctcaccctagagtaattaactatatttctactgaatttttctgataattttcaaaatattttctttgcatctaatcttatccttctatgatgtgttttacagtgttttattaagtatttagaaattataaaaatcattaaaggctataaaagataagactaacatgccaaatgactaatttatccagcagtttaagaaaccccctgggtgcttctctctttcctcaggcatgaccatttttgtgacttttagtttcatcagtcattcccttgatttccttaaaattttatcatttatgtctgtatccctaaaatatattgtttatttttcctatatgtttaaaagacttaactataaaataatactgtatatattcttctatgacaacttttttcactcaaaattatgttccttatcttcatatatgttatatgaatctttttttaaaattttcacggatgtataatatttcattatataagtaaaatataacttatttacccattccaatgttgatgggtatttgggagtttttcaatttctaaagattaacttaataactaacatgaatcattaattaatttacaattataaaaaggcatttcaatgaaaatgtatatatatgctttctgatatacaaatataagagtttctttaaataagaatagaaaaaaaacggttctttgaggatatgacttaagctttactagacaatgccaaataattttccacagcatttgtatcaactttatattcataatcctacctgcagtgcatgagaattttagctgctctgcatttgcattaagagtcatccattcctcatccagcagttactatgaccttttacaaatacaaatctgattaagtcacccaaaccttgcctaaaagcctttaatggtttctcaatgatcctaaaataaattctaaaagtttaacattgttgaaggattctttttgccctgacctctccctcatttagtattttatatcattcttcttgccttctatgtctatactggccttaaatttcttttttctgccccaaggccttcatatgataaacttcttcctggaactctttaattctacctgttcctctgattaacttttctcctttagtcatatattaaatgtcattacagcaaggaagcttttctggactcttcagaattgattaactcccctcatattgctgtaattacacattttctaaatataacatttatctcaaaaataatgaagaaacaattgtggtttaaaatgtgcccctatgtcctttgcagggacatgaatgaagctggaaaccatcattctcagcaaaccaacaaaggaacagaaaaccaaacaccgcatgttctcaccacattatctcctataagtgagaattgaacaatgggaacatgtggacacagggaggagaacatcacacaccggggcctgtcggggggtgggaggttagaggagggatagcattaggagaaatacctaatgtagatgacgggttgatgggtgcagcaaaccaccatggtacatgtatacctatgtaacctgcattttctgcacatgtcccagagaacttaaagtataataaaaataaaataaaataaaataatatgtgccccctaccaaccttcacgttcaataggttcaatcatagtttcttgttctgtgttgttcacaaatttatttagagcaactagaatgtacttgacaaatagtcaatgttcattatacatgctgaatgagaatgactaatctcctcaacacatacacagtatagtttatattaattttcattctagaagagatacatttttattcaacccatagttatgttattgttttactttgaatacccccaacttccaagtgagtggtatgcttttccctgccattgatgccatgatcttctttgaccaatgaaatgtgcagagtgtcatgaaatcagaaaggtgaaatgtgctcattcttttaggtgtgccttatttccttccactggcaccatgagagaggaacatggttgagctagcttgctggtctctgaaaaataagtgtcacatagacaagtgtagataagccaaataccatctgatcaacaaattcagagataaatacttctttttgaatgcctctgagatttggtggttatttgtagacagaaaaagttaacacacagagtagataaatttttacaaaggatacaattcttagaaggacacaagtttaacagagacaagtttctcaaggaattatcaataaaataaagtgaattcaatttaagttgaaatataaataaatagctgctcaaattcattttttcaaaataacttagatgaaaatgaaatacaaagttaaacactggaaaatttgagtgaagaactgcttgattttaaactgattataagccttttatcacataaatcttttcatgtgtctaggcataaaacagtaaggatcatggctgtcatcagctatgaatgacaatataccttactattgtatgggccagctttaaactgaacactttctattagctgtacagaaagggttttgtaatcttttcttggaatggcccctatttttcagagctgaaatataaaatgctattaaccaattaccagctatacctaatgttcaagtttagctttttagtcataaagaaaaaaaagctttttaagtttcagaggaagtgagtatatcataactaaaagcttataatttaactcatgtagattatacaattcaagtgcaattcatacccgctaagactatttctggtggcttcagcgactggaaatatctctaaccttataggccaagaagagacccgacaaaaggaagcctttcacttcatgccagtgtaagcttgatgtcagcattttctacctttattaggagagttactgtccttttcttacaggggagtggtcttatgttaggatccaaacaacactaatatgaggaaacagtaattctaaggaagcctcatcaactttattactgactcccctggctttagtcagtcctactaaggacaaacctctgacttcagttaagcaagtctgattctctcttgaaaactgagcattgaaattcaggtttagctaatttgatctatggtttatgcccagaatttaggtgatgtaaacaggaaggtggtcatgtggatgtgaagagagaaagtgaggccacacacagagagatgaaaatcaagccaatatagcacacatgtgcaggttaaagatggagcttcctgcctaggttctcagctgtcaattccattttctcccttgtgaagaggtcagtgtacccatgtttattttcatgtaattaaagtgaggtaagaactctgatctctgggttgctcattttcctgtcaaacttagctatgatcaaatgaggtattttacatcagaatctattatctgtaatctcagcaatcagctactaggaaatgtctcagtatataccaatcctgctttctctcattttcatagctgtagttctgtgcaaaatctaatcctttacagctgaatagctgaatatatagtaggggattgtttatatatttatattacatatttagatattggtggttacaataactacataggtagggatggagagaggcattgtggtccattcttttttttttttgttttttttgtggagggttgggggttgtcgaggcttcagttgggcttttcttgtttataaccaaaatatattactgtggattcagttgtgtccctctcaaaattcatatgttgaagctctaaccaccaatgcaactgtatttggcgatagatcttataaggaggtaattaagttaaatgaggtcagaaatgtggggacctcattcaaaaggattaatgtccccttataagaagaggctccagagaacccacttattgtcttcaaaatcccacaaatgaaagctgtgtaagaacactgccaaacagcgattgtctatgagccagaaacagaacccttaccagaaactaaatttgttggcaccttaatcatggcctttcagcctccagaactgtaagaaagaaatttgtgttggttaagccacccagtttatggtatttttatatagcagtgaatcccatgcctgagggggcccaatatttacctgggatcctccaaatttctacatagtgaagccagatgacacagcaactcataagttgtcttagtttcagaatcatctccaatgagatacagatctatcataaaaagcacacacctgctttcacagcatggcttaagggtgaaattttccctggacaaaaccaatttacatttaatttattgctacccagaagtatgtctggctttctgctttagaggagattgtcatgcagaaaaagagggaaactcataaacaacagtctatgacaatgtaatagaggtgtagatagcttgttatgggagaaagaaagactaactcattggaaataaaggaaaaatttacgcttagggtatttttgggaaaagtttaccctttctcacctgaaaaacaagacttcaggtacttaaggttctttgctgttatgagatttttattttggcttacttaatcagccttagtatgttaaagagaagaaccgaaaaaccaatgcaggatattccgataaaacacagatacttgaaaacttgagtggcagaaattagaagtaagaagaaaagaaagaaataaaaagtgtttttaatcagaaaccctgaatactaaacatactattttagcaggttgtagatattgttgaacccagcacatgaaggcaatagaaactaacatgttgagggtagagaaataaaaagaacataggctagtaagtgatttaggtgcctcacttttatggcattcttttccaagatgggaataatgttgatttatcctttgtgatgtcagcccctagcacagtgcctagcacataatatgtgttaaataaattccagtcatagggatgatgcgcacaagtacgtggtttgctgaagagggagccactaggtggctgggcatccaggagagaccactcggacaaatttaaacagagaggacagaaaagacctttcatgtactttacgttttttacataagcctacatatagttcgtttatatatcctggtcccatatcaagccttaaaattaatattttttatttcagctttaatatgcagtcactgtaggccatgttaataaatattctttattttagtaagtaaaatatttctttttaccaggaaagctatatgcagtgaaaacgctgatagattctcctaattgaaactacattgctagttataccctcgagtacaggtcttatctctacttaatataggatgctaagaatcatgacactattattaaaatagagacacattattcttcaggtcagaaaagaattggtatgtgtgaccaaggggtttatacattacatttcatcacaacattgtcattcttttaatatagtgcagaacactaaaagctattgtttccatgaattacaaccccaaatactttcactctgcagattcattttatcaggatctcagtattatacatcacaactgtaatgtgtaacatattttcagtacatatctttattgtacgttataggctaaagtagcataattatcattatagtaaggttttacaagagactttatgttttaatttttatgttcaaagttatttaagtagtcactgcaagaagaatcttaaaaaatactcataagttatactataaaaccagtccttggagattttaaattattttcaatttttagggggtcttttatgagaagaaatattttatcaataagggagtaaacattttcaatgcatgctcttcatttcacattttgcttcagcttgcaccaagtggttattttgcaggaaaacaaaacaaaacaaaaaaaatattaaagactcaactctgctgcactaaagtaaatcaaaagcaactgcagaaacaaaaagctgtttaaatgcaaaaccttgccaacttttctgtcagggtatacaacttttaaatggtgtctaaatattttaagcataataagaaatagatctctaaaacttatatcgctatccacctctagcttctgagataaattctggcctgactaaccattagtagataattagaaatgaaatgggagatccaacattaacacagactttctttttttttggcttaggagcctcctttatgcaaattggtaggagaccattttcatgcagttctggcaatcagtacttaatttgttgatagccttaacagttgtggccagagtataattggtatgggcccttgtgcaagaaaaataaattgggttgtgcacaaaactaagcaacataattaccaacaattagacgttaattaccaagtagcagattctcaaacctttctcctgaatttggccaaagctagacctaattatatttttatgttgtgaaaacatccatgtgcctgagataatcaggtgttccgaaggtgccttctgtagatactgtgttttgttatggattctcatgtcaggaaattaaatatgtttatatttgggcttatctaataatcacagaaaagttagtgaggtgggatttgtgctaatttggtagtcatttatttaccttacctatttaatttgatcacttctgaaaatactgatgtaaaaaagaatgaaaattattttaggattataaaaagaaagaacagaaagattttgctcaggcaaaaatagagtttctccaagtatccttcactataacaaagaaatcttttccaatattagaccctaggggaacacagctacagccacagtctgcataacaggtttttactactagatgcgacatgaaaagtatttatacaaaaaaattagcagatcaaacattatattataactatgaatgaaaacagtctaagacatttttggggaacactaaaaatatgttgcagacattccttttgatcagaaacataataatattatcaaattttaacagcaaagcaacatttacaacagcatagcaatatttacatagcaaaataaacattttcttactttgttttctatgatccgaagacctgaaaccaaggtctaagagttatcctaccagggagtagtggtaaaatccacttattttcttacatgtatattctaattatggctggcgggttattctgtgctaagatcacaggtaaaattaacatttttgcattcttgagggaatccacatgtcccatcgtgttttcacttcaacacatatttgtttattcaattagttaagagatacacataccattctctgaggaagatgagatacagttttcttcttttcttttttacattagtcctcctgctttttcatcttccattcactcccctggactgagaattggaagttaattttaaaagtatttttaatagaatgttatctactggtttcttttccgtgttctcttattctatttaaatctctctaagaactgggaagttatccgatctaatggcctcttcaaggtcttcattctagacactgcagcactggatatttttgagattttcctatttcttgaaagcttctcttcccatgaattttataatattattttatttattaattaaaaatttagtgtcttctcaatagtaatcagcaaaatgtaaagtttaccatcattgagattcaaaccctttacaattggacaacaatcgaccttatttggtacttgctttatacattctaattctctccttttttttttttccagattataacatgtactttcatgtccatttacctgtatccttgcattttccacacctggcaatgtcctacatatattaaacttcaccaactctgtaaagtttggaagtatttctactgcacaacactcaacaaacagactaaattatcagaccatctaaacaacattggatggattctttcttgtctttagaatgtctagaaaaagatgtggaacacctacattatgaaatgtgtgtgtgtgtctggtgtgtgtgtttatgatttttatttatttgttttcaactagaagggcatgcatgtgttggacccatatatgtcttagaaaggtgggttgagttttctaagactagatgaggtgagggtatagagaagaaataagatagcagaaatttattaaatttttttttttttgagacgtagtctcgctctgtcgcccaggctggagtgcagtgccgcgatctcagctcactgcaagctccacctcccgggttcacgtcattctcctgcttcagcctcccaagtacctgggactacaggcacccgccaccacgcccagctaattttttgtatttttagtagagacggggtttcaccgtgttagccaggatggtctggatctcctgacctcgtgatccacccgcctcggcctcccaaagtgctgggattacaggcgtgagccaccgtgcctggcctattaaatgttttaacagtacatttttaaatattacttaggatagtttttcctcctaaataacatgtctgggtgaagtataatcctaatttgagtggagcattggagatatttacagaagaaaagttggctctcctttaaagttggacaaattgctatagtgtgatggattactagagaggaggaaaaaatggaaatcatattgagtgaaagtttttctatttaagggaataaatcagtagtataattacttatgtttacactaatattagtaacttatagaggagacactgtaaattatgatatataggtaagggatccattatttggacagcatagaagcacatacagaaatataaagtggtctctctaagacaatatttgagagacaaatctaaggctaaatttaaagcctcttgatttcagaacaaaatatttactggcttccattgagagtaaaacgaagaagagagaaaaatttgaaaaaccaaaacaaaataatgttaacaaaaactacaacatctatattgaagcatttcataaagaactactaattttgaaaagaataataaagtgaatgtctaattaaatggcgcatttttaaaagacttcttgcaaacactctttttgctgtcacttaaaatttgtgctccttagagagtgaaaggagagaaccaggaatcattaagcctagtaccataatgaaatacctgcgtgatgaaacaatctgtacgacaagcctccatgatgcaggtttacctgtgtaacaagcctgcacttgtacccctgaacttaaaataacagttaaaaaacattgtgtgcttatcataatttcttgaaacaaattgtatatgcaaaactgtgcctctgcatctgttaaaattaccctgattggccacttgcattctcagagagaagggtatagagctaattgaccttgccagagaccaaatgtacctactgtgttttaatttggtgtgcaattctatgtctgtgcaaattttctcatgccaattattgcacttcaaaaaatctgcatcctaccaatatctttgcaactgaacagaaagaggagagaacattctctaaacaatgcaattagagcagtataggcaattaactttgctatttagtctaaagtagacagcactaaagacaaagtaataaatattcataaacactttaccattatatggaattgcagaatagacacacatttttaatacacaatacaggcagtcatattattaaacttaatggcatctgaggaatgatgaaactctaagagccttgagcttgtaatgagataagcttgtagcctgatcagcttgcatacaaatcatctcatctgaataaaattaatgtttgatttttatatctctcctcaagcactgctgtgcccccctattcattttatgaacaattattgaaaagaaaataaaagtttagccctgacatgatatatcagtgggagggtctacaaaacatgacattttaagttcttatttctggtgttgaatgtaaaatttcttataggttaataattgaagaatgaattattgatgctaaatacaatgtgagaaatattttaaagcttttacattaatatagaaactgtttattttttaaattttttcataaaaatgtttacttttaaatttttttcatactcctcaataacaacatgcctgtatttaatgttaaaatgagtggtattcatatatttagttgggtttccatctgcaaaaaaagctattccctctaaatcctcattttaaaattataatattaaaggagataaatgtgacatggctatgtcatttcaagatcagtcaaaatagaaaaaatatgtacttcattttaacttatgtaaccaaagtttacatttaaaagtttaattccaaagtaagttttcttgtgtcacttctttttgaggtgagttcatttttacagtgttcacttaagacaaattccaagcatctcagggcaggatattgccctcttctctcacattttatacagcgcctagtaacatttagcatgccatagctatgaaagagtaaaaagcacaaaatctaaattttcactaaaaatcttaactgacaaagaaagctgtaaagaaattatctaaagtagatactccttgtgggttgatatcttagaacataattcttcaacaggggtctcatattatagtcatccaaaacatgacttacagttatttgaaatatcagtatgaaaatttatcttcaaatacaacattatgaagaactaccatggttctcaataaagagaaaatttaaggcattcataaattaaagagagtattttaggaaaagtagataaaatggtaaattaaaaactcaaatttctttcttgaattatcctagtttactattagatattcatttcactgtatttgtgcagacatctaagtcagtggtccccaactttttggcaccagggaccggtttcatgggagacaatgttttcatgaactgggtggtggatgggtggaagatggtttcaggatgaaactgttccacctcagatcatcaggcattagttagattctcataagaagtacacaacctaaatccctctcatgagcagttcacaatagtgttcttgctcctgtgagaatctaacgcccccgctgatcttacaagacatgaacagacagtaaagctcattcaccctccactcacctctgtctgtgtggcctcattcctaacaggccagggtaccagtccgtggaccaggggttagggactcctgatctaaatgacataactgagtattaaatgggttgaaacatataagggcatacaatactgcctggcaaataatacacgttcaataagttttagttattactcaataactgtccctgcacttccactccctttagtactcttatgcccaccaaaaatcacttgtgttagtttgcatacatgctttttgcaagctgaacttttcctttaattcaaaaattataaaatttggaaagaatctgcagtcagattccaagttctattaagagttccttcttcaaagaaacaaaacctggaaatagtggatggtgcagtatgtggtggtttatacaggaaattgtgttggaggtcttcaagataacttcaagctcaataatttgcttgaaaaactcacaggattcagaaatctcctaggtttatggtttatcacagagaaaatagagattaaaagcaacaaagggaaaaggtgcaaggtgcaaggaaggaagtccaagagaaaccaacagaagtcaccccaggggtcctctcccagtggagtctcatggtgatgtatgtaatcctttcagcaatgatgtgtaacaatgcatgataagtgctgctaaccagagaagctcactcaagctttggcatccagggtttttattgggggtcagtaatgcaagcatgcaatgccagtgcaattgaactcagctactcagactctcccctccctcagagcaaaaacaggcattcaccataaatcacattcttagcataacctttactgctcagactggtaaagcatgtcccaaggccccaggtatacaaaaatattcttatcagtagtatatttcaagttctcagagattatttcctaagattcagtcaaaagccaataccaaagacagacccttctttggaatgtgcagtttgtgagcaaccaagactgctgagttaacctttttctgcctgaaattacaaaatggaagtgaaatcagtgccccagaacacacagcggaaaaaaaaaatgttgacactggccgggcgcggtggctcacaactgtaatcccagcactttggtaggccgaggcgggtggatcacgacgtcaggagatcaagaccatcctggctaacacggtgaaaccccgtctctactaaaaatacaaaaaaattagccgggcatgttggcaggcacctgtagtcccagctacttgggaggctgaggcaggagaacggcgtgaacccggaggcggagcttgcaccattgcactccagcctgggcaacagagcgagactctgtctcaaaaagaaaaaaaaaaatggacactatgtgtaaagattagagaataagtgaatgaacacatccatatgttttatttaaataaaatcttgttacctaattgtaatctttaaaaatatcatgttttaattacttttctgactaactgaacaatttcagtaatccaggtggctctttcaaaattgagcatggctcatagtcatggcttatgccctggtttatgctttaatgccctggctcctaaggcagagccttaacgttgttcctatcactaaggctattctataaccttgttttcttcaaattcctgtatgacaatttaaggctgtgggccagatgtcccagcttggtatactaacttatgtgatccagtctgtcttcctggtcccacacctgacaccatgcttacatctatcaagttcagcaatcctgttggtacaacgacttgttgctggaactccctgagagtgccttcctgagctgccactctcactctaacacctccatccccgctgtgtcacttgacagatggggctccttccaaatccctgtaatttttcctcaggctttaccctatcatggtaagtaagcttattgtcttagtctgtttgtgctgctataacaaaacatctgagactgaatagtttataaaaccagaaatttacttctcacaattctggaggctagaagtccaagatcaaggcgctggcaggttcagtgtctggtgagaacctgacctctgcttccaagatggtgcctcgttgtgtgtccactagaggggcaaatgctgtgtctcacatagcagaacagtggaggaaagcaaaggcactccctctagcctttctataagggccataattccatccctgaggattctgccctcatgacttaatcaccttctaaagatctcacatcttaatactattgtactggtgattcagtttcaacatttcaattttggggagcacattcaagccacagcacccacactgcttccatgtcctcacatggatttctcttttcccatcgtatatcacacagggctactctattcatagagaaatctatcttttattcacatgacatgcattcaacaagtatttagtgatttagcaagtggccattacataccaggtactgttctattaggaaatatgagagtatgtagttctagccaagtaatgtccttgttaacacatatgcatttttgtgaaacacacaaacccaaagataaagtccaagtctttcccttaataaacaaaaaagggtcagaatatagaaatgacttccaaagtatcctctcttgcgttttttttcctttcagtcatccgtgggtctatctgtgctttaataatgcttccaatccagttcagatcacttttcagtcctaccaataatattacaccctgatcctgatagtacaaactgttacattttccacttcacagatcccaatctgcaccactgattatgaaacaaatattctttgttcctgaatgactgtagatgtggtggagagtaccaaagggtcacagcctctctcacactaaaaacaagaataaagcagtgagttgccctctctcaattcaaacagctgtaaacccaacaagtacatggcctctaattctcctactcctggaggaaatctcttgactgcacttacatttaggccactaaggagaaaaaacctaccctcaaatgaatatatcagcacacaatagaaatacacaacaaagtaaaatatttaataaattgtttgaggtaaatcatgaaagtataaccctaaaaaccccaaaatagacatagcattgaatcctttgaagactcaatttacagtccatctcatgtgttcagttataagttacgaaaacagttacctctaaaatattgttaaataatcaaatgggtccatgatatggtttggctgtgtgttcccacccaaatcttatctctcattgtaatcaccatgcatccaggtagggacctgtaacctgcatgtgtcaagggagggaagtgactggattgtagggaggtttaccccatgctgttcttgtgataatgagtgaattctcatgagatctgatggttttataaataacactttttcctgtgctctcacttctctttcctgctgccttgtgaagaaagtgcttgcttctccctttgccttctgccatgattgtaagtttcctgaggcctcctcagccatgtggaactgtgagtcaattaaacctcattcctttgtaaatttcccagtttggatatttctttacagcagtgtgaaaatagactaatacactccccatgctccattcttattgtgagcatttttttctttctctgaaaattaactttataccaaaaaatagattatgatgttatagataaaaacatttcagggatgtagaacattatcaatcaaaagacgctgaaaagagaaaaggaaagttatagggattcatattgggacaaaacacatttaccatcacaaagtagaacttgcttggtattgagtactttttgagtacattccaaagttcattaccatgaattgtatttgagaaagtggaaggcagttctctgggtggccttggactgacccagttctccccccaccatttcttgcttatagttctcaagaataagtatgaaataggctgggaattcaacatcctgaggtaagggggaattggccagaacagcccgggctttgtttcagtctaccctggaaatgagatgttcgttaatgctgtagcctctgacggtgaggcattgtcccttaggtatataattgggagtgggctgcctttcagggtccctcagctccggtgtaagtcaggcaagtgcaggcaaaataccattcactgtggtcagcttttttgagccttggtgaatcctatgcttctgttgtccctcactgcctatctgtaaaaaataaacttgcttcttgtaacttcttttgtgtgtggatgttctctctcaccaggctgagatcagttggtaacctgtgcacagtgaatctgcccaacggaaatggacctattggttctcacattatactttaattgcaattttagccacatctagatcaaaaaaaagataaataagtgaatttcgtttttggcacaccaaccattttctgcatcaagaaccttacttttatgcagagcttagcaatatctagtacttcatctgtatcaatttttcattttatctacaattacgtgttgagagcttcccacgtgcctgatcctgttccagatactgaggagactgtgccgaatcagacagataagacagctatgtccatggagctcatattacggtggaaataagaccaacaaattaaaaagtaagctataaatgtgtgtgttctgaagaaaataaagtgggatggcatgatagagagtaatgagagagtgataatttaaattaagtggtcagggatggcctctattaagagttgatatttaaacaaaggtacaaatagaagatgatcctggatgtgagaattacgggaagagggaattaactatttttcaggtagggaagagctaggagaatttagaaaccaaaaatatcaatgtggctgtagtacagtgaatatgtagcagaaatcataaaagatgaacttcgcaagttagttcagagccagttcatagaactttgtaggcaacggaaataattttgtatcaaagtataatgaatagccattagatggtttagacatgtgtgtggaaaatggatgggaagaaatgaagtttggaagctatggtgcagcagtaatatgagtaagagatgatggcaccatggaatagaaggcatagtaatagaaaaaatacaaaatagatacattcgtaatgtggtttaggtgctctaaacaggacatgattatggtagtctgtgggtttaaaggaaaataaataattaaaggatcaaagatgatcttagatttggggcttcagtacatggagagatggtggcattatttactgatatgcaaaggtatgaaggagcaggtggagtgcatttgtgtgtttcagaaatgttacaacagatgacactgctagattgccaactggaaatatcaaataggtgaaaacaattatttatatattctatataattttgtatttgtgtatgtctctaaacttatgtgtgtatgtacatatacacacaaattatggtgaaaaaaaggtaagaaaaaatattctaaagttggaaatggggaaaagagacacttggtgttcttttaatccagtgctggccttgactttctattaactaggccattttccaactctgtagggatggaggctaacttacacatttgctgttgctattgtgtaaatatgaatatcattttagtctagtgaaataaaaaaagttacagcatattgccctgtaaaatattaaccagttttgtctccaacctggaaatcttaaaatttctttattaaattgcatattatattaatacatgcatacatgtacacatatataaacacacatatatatacagttattttctcatatgctctttgggtcagtttcaatatcttgctattaattaatgagttaaacagaatctttggcatgtgttcatttcatatttgccagagattattgtgtttatctttttgaaaattataattaaatagatatgaaggttaacatattaatctgagagtcactgacatgtggatgatagctatgaaactgatgagattacattttatttttctttgaggcggagttctgctcttgttgtccaggctggagtgcaatgacacaatctcggctcaccgcaacctccgtgtcccaggttcaagcgattctcctgcctcagcctcccgagtagctggtattaaggcatgcaccaccacgcctggctaattttgtatttttagtagagatggggtttctctgtgttggtcaggctggtctcaaactcccgatctcaggtgagctgcccaccttggcctcccaaagtgctgggaatacaggtgtgagccaccgcgtccagctaagattacattttttaaaagtacagaaaaacatgtgagaatagttttggttccagagtataaggaacataaatatcatttcactatttgtttagaaaaactctataaggttttgttatgttcatttttcatttttctactgagtaaattatggctcagaaaacttggctcagggctttgcatctaaaaaatgttagaaagcaaatgcagccctggtcagtttaactcaaaaatttattttttccacaagagcaagataattctccagaagaaaatagcttaattttttttaaataaagctaatgggcaattttggcaatttcccttctctttattcccatccccctcctggtgtgtgtgattgctataatttaggccctggatactgcagaaatatttcttaacctgtataatctcaccctaaagagccacttcaaaattggtaagtatagatcatgtcagaaatgcaagtactatcatgatataaggcattttgctttaggcaaaatatgaaaaaaaacagtttacacatattgcaatatttttaatatatacatttataattttttttaacggaaagtgcattcatgaactaagtagatgattacattttcctctttttaacttaggactttccattttgtaattataagtaaatgcataacgaccatcggtcgatcctgaatctaaaagtataatcaattacatccatatggaatttaaaacataataactttaaagtattacttctttaagtgaaataattcaaaatgagattaaaggcaatgcttaaagaacatattatgtaatgcaaattaaatgtgtcattattaccctattattcaccacatttttaatatgcatgttcttgttatgcaggtagataaaaatcattttaaagagcatagaaaaataataaatcccctgttattagtcagtttttacactgttatcaacaactacctgagattgggttatttataaagaaaagaaaaaaaaagaaaagagatttaattgatgtacaattccacatggttttggaggcctcaggaaacttacaatcatggaggaaggtgaaggaaaagaaagacacatcttacatggtggcaggagagagagagtgggcgaagaaggacgtgccacacttttaaacaaccagatatcctgagaacttactatcatgagaacagcgtgggggaaacggcccccataatcctataacttcccatcaggctcctcctccgacatgtggggattataattccagatgagatttgggtgaggacacagagccaaccatatcacccctctatgacttatacaattcagtaataaagaatattaaacaactgaaaaatatactttattcaagaagcagcaatgattgaaagtgattgaaaataataaatcatattgcccaaatgaaagttttaaaatataataccaattatattgaaaacgatacatttagctagatgttggatcattactttacatatatatatctccttctaataaatcacaaccctttgagggcaggcaaggatcataatgatactcatctgtgagtttccagagcacatagggagactctcatacaaatacattaatgtagtctatgtcctacatatcataaatccatagcctaaatcttactagaactctaaaaatataacattacagaataaaattcaaattttgaccattttttaccttttagagatgtttactaattattttttaaccattatgcattattaaaataaagcaaatcaaggttggaatttggctgctctaaactaggcataaaatattgaaatataattgttaaaggtatggaatatgtaaatgttcaatacaataaataagcaaaaatttaaaaactgtaactttatttcttcttcttatttcatgtctttattttaaaagaatcaacaacacagaaccagatgctgaaggtctataatgctttattcccatttaggtgaactgtaaactattgcatataatgtgaaaaattcaaactagggaattttataaaaacaatgaaggtcatatgtaagttacaccattagagaaaattaaatatctaaagtttactgtaattattcacaagttataattagattatacctccttggttagctatattcctagatatctgatctgctttgtggctattgtaagtgggattcttttcttgatttcactctcagcctagacggtgttagtgtgtggaaatgttactgaattttgtacccctattttgtatcctaaagcttaactaaaattgtttatcaattctaggagtctttaggcagaatacaggattttctaggtataggatcatatcctcagcaaagagagatagtttgacttattttcctattttggtggattttatttatttttcttgcctgactgctctggctaggacttccagtactatgtagaatagaagtggtgagagtaggcatccttgtctttttccagttctcaagggaaatggtttgagcttttactcatccagtatgatgtagtccgtgggtgtgtcatgcatagctgttatcattttgaggtatgttcctttgatgcctagtttctagagagtttttatcatgatgggatgctggattttatcacatcattttccgagtattgagacgattatattgtttgatttttttatgcagtgaatcacatttattgatttgcctatgttgaacccgcctcacatctcaggaataaagtccagttgatcatgctgtattaacattttgatgtgctgctggattcaatttgctacttttttttttttgaggatttttgtgtctatgttcatgagggattttagtcggtagctttcttttttcattgtgtctctgccagattttagtatcaggctgatgctgccttcatagaaaggattagagaggagcccctcctcctcaactttttggaatgattttagtagaattggtatattttttttctttttatacatctggtagaatttggctgtaaattcacctgaaccagggctttcgttatggttagcaggttctttattactgattcagtttcagaagttgatactggtctattcagggtttcaatctcttcctcattcaatcttgggagattgtgtgcttccaggaatttacccatttcctctagatattctaatttatgtgcatagttgtccacagtcatctctgagtatatttgggttctgaggatgtatttgtggggtcagttataatatcacctttgtcatttctgatcgggctttacttgggtcttctctttctttctctttgttcatatagctaggaggcatatcaatcttatttatttatttgaaaaaccaattcttggttacgttgatctttttatagatttttacgtctcaatttcattaagttcttttctaattttagttatttattttcttctgctagctttggagtttatttgctctttttttctagttcctttaggtacaaagttacattgctaatttgagatctttctgtcttgacaaaggcagttaggactacaaactttcctcttaacactgcttttgctgcatccaagagattttggtgagatttttcccctgttttcatatatttcaaagacttttttatttctgccttaatttcaatgtttgctcagcagttatttaggagcaagctgtttaatttccatgtatttgtgtagtattgggagatttgtgtagtattgggaatattgtgtagtattaagaaatcaataggtattgatttctattttcattgcaccgtggtctaagagtgtacttggtatgatttcaatttgctttgaatgtattgatgcttgctttatgagcgagcatgtgatcaatcttagaatatgttctgtgtgcagatgagaagaatgagtattctgtggtcattgggtggtgtgttttgtagatgtttcttaggtctaattggtcaagtgtcaagttgaagtctagagtttccttgttagttttctgtctcaatgatctatttaacactgtcagtggagtgctaaagtctcctacaattattgtgtggttttctaagtctttataggccaagaagaagttgttttataaatctgggtgctccaatgttggatgcatatatatttaggatacttaaggcttcttactgaattgtaccctttatcatcaagcaatgttcttcattgtccttcttaatttttactggtttgaagtctgattcatctaatataacattaccaactcctgcttttttgtgtgttttctatatgcatgtatatcttaatctactctaacttttagcctgtgggtgtcattacatgtgagatgagtttcttgaatacaacagatggcagagtcaagacaaataaatgggaaaacattccatgctcatggattggaagaatcattattgtaaaaatggccatgctgcccaaagcaattgacagatacaatgctctttctttcaaactaccaacataattattcacggaattagaaaaaatgattccaaaattcacatgtcaccaaaaaagagcccaaatagccaaagcaatcctaagaaaaagaacaaaacttcagctatcacagtacttgacttcaaactgtactataaagccacagcaatcctaacagattggtactgctaccaaacacagacacatagaccaacagatcagaattttaaaaactcagaaagaaagccacacacctacaaccattctttgacaaggctgacaaaaaaaggcaataagaaaaggaatctctatgcaataaatggtgctgggataactggctagccatatgcagaagattgaagctggaccctacctttcaccatatacaaaaattaactcaaaatggattaacgatttaaatgttaaaacctgaaactataaaaatcctggaagacaacaaaagacatactcttcttgacactggccttggtaaataatttttggctaagttcacaaaatcaattgcaataaaaacaaatagacaagtgggacctaattaaactaaagagcttctgcatagcaaaataaactatcaacagagcaaacagacaacttactgaatgggagaagatatttgcaaactaggcattcgacaaaggcctaatactcagaatctataggggacttaaatcaacaagcaaagaataacctcattaaaaaatgggcaaaggacatgaacagacattttgcaaaagaagacatacaagctgccaacaaacgcatgaaaaaatgctcagcatcactatcatcagaaaaacgtaaatcaaaactacaatgagataccatctcacaccagtcagaacagctattattaagaagtaaaaaacaagagatgctggtgaggctgcagagtaaagggaatacttacacactgtttatagtaatgcaaattggtcctgccactggaaagcagtctggagatttcacaaataacttaaaacagagctaccttttaactgagcaatcctattactgggtgtatactcaatgggaaataaatcattctaccaaaaagacacatgcactcacatgcttattgctgtactattcaaaatagcaaagacatgaaatcaacccaggtacccatcaataatagactggataaagaaaatgtggtatgtgtacaccatggaacactatgcagccataatacagaatgaaatcatgtctttgcagcatcatggatggagctggaggccacaatcttaagcaaattaatgaaggaagagaaatccaaataccacatatccttacttacgagtgggagctaaacattggatacacatggacataaatattggaataatagagagtagtgacaactagagggtggagggggagtgagttaaaaaaactacctattgggtactatgctcattatttggatgatgggattcataatccaaacctcagcatcatacaacattcccatgtaacaaatctatacatgtactccctgtatctaaaatgaaggttgaagtaaaaattataataataataatagattataaagcctttaatatgtcaggtcaacaaacagctattgacagcaaatatatcattagcaaatgttgttaactaggaaagcaaatattcattaaaataaattaaatttgcatagaagctaaataacttgttagttttaatggttttatctacatccaaaaataattggaagtttctcctatcaccaatactttgtgggacattctactcagattttccacaaatgtagaaaccaaaccttatttccaaatactatatgcttagttcttaggataaaagttgtatagctatattaaattaatgcatgtctgttatacccacatagagcctctgatatcagtaagtctgggatgggccctagaaatctgcatttcaaatctcatgaaaatctgattccagtactctgcagagccttctgtgagtaaaatcgctacagtcagtacctaaattctgcctttaccagaaagcttctgcacacacttttctcatgatattgacattatagaacaacaattagaaatcatcctcccccccttttttttctttttgagacagggtctcactctgccaccaagactggagtgcagtgatcaaacctactgcaggctccaattcctgggttcaagcaatccttctgcctctcgagtagctaggaccacaggcgcacaccaccatgttaggccaattttaaaaactttttgtagagacaggtcttgctatgttacacaggcaggtcttgaacgactgtcctgaagcaatgttcccacctcagcctccaaaactgctgggatgataggagcgagccactgtgcctggacaataatcaaaatttcttagaaaaccagaccttctccatttcacaaacttttatatcattaacaatgatcctttgactagaacataacagatttttttttgttgaagtattgaataaatccatgttatcactagatcagtcttttaaataaaattactgctttaaacagatcattctctacataagaatgcttaataaaaaatacaactttatgaaattctaactggataacgtgaaacatttttgaactacatggaataagacatcacatgaaccactgaacccttatttgtaccaaggttgtgtttcacaattccataattttcatctatcaatcaatttatattttgcaaatccttattaggaaacttaattcatcataaccctttctcatatgatactttaaaatcttattgtaaaagacatatatgcacataaagatatgaaagtatgcaagatagtagatagcaaatttgtagttttatatatttacatatgtgcagtagagggcagttagcatacctgagttggttttaaatgatagttagaattaaataagcaaagagggaagaagggttttatagacatggtgagtgaaatataagaatgtcagatgcctttgagagtaaatcaaattgacaaaaacagaaggtttatagagagttaaagtgtgaaataagttttaaaggacagcttttaaaaggtagctgtgttttaagagacttatgtctaccaggctgaaagatctgaagtttaatctatgggctctgtgtttccttgatgattttggtaaaggtaagttgccagcaaattgatgtgaattaggtgatgtccaatatctttaaaattgaaaatgaaatactttgcaaaactgaaacgcatgtattttactatttaatcatacatatttaatcaataactgtttactgcatactgagtctatgctgtgcactctgccaagcaatgggggtgcaaagttgagcaataacacgtacataagatttaaagtctaatgggacagatagacattaatcaactagtcactaaatagtcaaactattctaactggtaatttttctatggaagagtgtatgatgttttatgagcacatgttagggatggtttctctgaataagtgactttgagttcagttctgaataaaaagattagggcagagataattatgggcagaagaaggagcatgtgcatttgtttgatgggccacagagcacggtacccttggggatttgaaaaaaatgctactgttgcagagtgtgagggtgagacaagttatgttgctagagaggaaggcaggagcccacttagcagggcaatttaggccattttaatgagattggacgtgaaaagaccactggtggtgaggatttattaaaatccctcaatttctgctagtaattgaaggattttaataaaatgttgacattgaactaaaaaattcatttaggctaaaatgtaggaagggaatattgaatatctgggacatatggttgttaaaatgagtagtccattcaggtttaaaatgatattaaattttgaatatgataatttggtagataggaacaatgaggcagatttaaaggatgtttagaataaaccttagtcacatattggctattggaagttagaaaaaaaggggatttcaatgataacaactaggttttaagctaggataattagattgattatgggctgattcattaagacaactaaatacatatataaaataattaatgtagatataaataatgcatttgttgacaacatcacaaatatatgtagttaatatactctttaaaaattaaacattccacacacacataaattatgggttctcttttttaatatcacatgtaatctaagcataattttagaacagtttattgttttacatgtattttgttaacacattatcctacagtatattcttatgaatatcaaagtctgtctatgagctaaacattttgtttcttccaaagtatttccatttgttcatatgttcacaaaggaaactgtttaggtgaagcttcacaatatattcaagtatgtggtaggacaattctttcttcattattctcaaattaccttttgctttcataggctggtctattatttaaatcactttgagaattttattgtcaagtgctactaaaattgccaatggaattttaactgaaatcaatttaaaacgatgatataaatgagagatatttgatatttttatacaatattctatttctcaaacttattttgacatgaaaaacactataattagaaaatgtaatggtagacaactcatatttattatttaattaataaaacgggtagcttcatttgtttttctaagtgcataaaattgtgatacagaaagaattttagtggacatagtagagctgatcctggcttcatcaatgtcaacatttgaaacagctaaatgcttgtagattattgcatatgtaaaaatcaccaaatttaaaatttaagcagtgtctaaatcacgctcttaattttgaaagtgtactatgtatgcaagaaaataaatgtgctttaagaatctgcatgctactttgctgtctgcaacttgttacttttattatctttgagtcatatctaaaattatctacatgtattgaaaattgaggaacaagtagaccacatatatagaagtatagtcaactgtaataaatttaaaatattttgacaggttgaaaaccatttacaaaattattaagataataaaatgcatcttaaattctaaactattactgattccatacatgatgtagaatttccaaggttgaattttacttctgaaagggaaaaacaaacaaacaaacaacaacaacaactatgtactagaataaaatttgactactaagccgggtgggtgcggtggctcacgcctttaatctcagcagcttgggaggccaaggcgggcagattgcttgatgccaggaatttgagaccagcctggccagtatggcgaaaccccatctctactaaaattacaaaaattagttggctgtggtggcgcaggcttgtaatctcagctactcgggaggctgaggcatgagaatcatttgaaaccaggagtcagaggttgcagtgagatgggatcgtgtcaccacactctagcctgggagacagtgagaaggtctcaaaaaaaaagtctattaaataactatggttagacatttcttaacatatatggtgtaacaatacgtgaaaatctaaataatccttaccttcctatccttctataagtatcactgcagcacattatataacgtacataaaaaattaaataaagcaaaataactcaaacatgtaaaaagaataactcatgaaaatgatgaccaatattcatattaacacgataaagtaaaagacagccaacttgaaatattaaacttatatttggcaagtatgcataattatgaaataatatatttaacttcatttgctgactttgaattaaaattatataccttatattttggtaaattatctcatatactttagttctctcaacaaccctgcttatgaagaaatgaagactattgagtttatgtgaagtgcttaaagtgacacttctagaaagacacaaatacaagacctaaaactaggtttcttattctatcaacaaagctcatttactcaataattactctatggcaagtttggtgttgaaaaacacatttccactaagaaatgtttacaaatgagacaataactcaataatcatgatagttatagtcatacaaaattgtacatttgttgaggtcagaaattatttcttctttttcagttcacagtatttattacaaatgttttgagaagcactgatgtagatggtggttaataattgtttattgaattaggcaacacaatgaaacctcattagtttaaactaaatagagaaagcttaatctgaatcagtgaatatcttagtctgttttgtgctgctataacagaataccacaaactggacaatttataatgaacagaaatttatttggctcacagttcttgaggctgagaagtccatgattgattaagaggctgcatctggtgaggaccatcccatagcagaaggtttaaagtaaagagagcaagcacagttacatacaagaaagagaggggcaaactcacttttataaaagtccactctctggagcccattcctgagataacaatattaatcgattcataaaggcagagtcctcatgacccaatcacctcttaaaggtccctcctatcaacactgatgcattgaaggttaaatttcaacacatgaactttggaggacccattcaaaccacagcagtgaacattttcaatttaagactatcttcttaaaagcgtaactaagttctaccaaaacatttatttcaaaaaatctatgagctacctcttgagtcaaatagtgaataaggtatgctgtcttctgccagtgagcacacaacctagctcaagtatgttaagtgttatgataaaagttttcataagaaggtagaccaactaatgccttttaatggtaaaactaattggatttaaatattcaaaagtcagtgttctctttatcaaatatcatttgtgataaatttagaatttattcaagaaatattcaaaatagcactgttttatagttataaatcccttttgttcaagtacaaatctgtataaattgtctcttttcatgtgcgcatatagcacaagtcaaattaactctagtttagtctcaactgggacacttaaactcccaactacaaagttatcatgttaaattactgaattacttcttgagaaattatcaccagtaatgaaacaaatcaagacatgtgccttccaatatgatgtacagcatcacttattcagcatttttttcagttaccataattagaaaattattatgacataaaattacccaaattcatattgagagatattgtataaagctgctatgaactcttcaaaaatgtcagtgccaaagatagaaaacaaaaaacaaacaaacaaaaaaccagaaagattcaggaagtatgtgagactgaaagaaattaaaataggataactgactgcaatgcataattctgaattttcctgttcagtaaaggacgttattgagacaaatggagaaattaataaaatctgtagattagattatcatgttgtaaaggtgttaattttgttgtactgtgattatgtgttttccactgttcctgatgcctagacaaaaagagtggatgaaaccatgtgagaatttagtaaatacagatgacctgacatgcagtgtctgaggtaatatttttatatttgcttcagaaaacaaaagagtcttttcttttgctgtagtccaggtcccgtaccattacagcttcttttccttcttggctgagtacaatcttatgaaatctaagtagcatcaataactatgttcttgattgtttgtatcgctttgtgtactttttaaaatgagtttcatgttggagataagattgtaaaaaaatgtgggggaaaactgcccccaaaacatgtcaaagtctcttgataaattcaggcgccagaagttttctcaatctcttattatctgagtatcttactcattaataaatagtgatgttagcagagagaatgcatcactttcttctgcggtttccactcttgaactattaagtcttgacaccatgaaagaatgaggagacaagcacagtaaagatgaaggcaaaaaaccatgcaagggtttcttcatgtcttgggtcttcataagtttgcccttgccagacttctagctcaatttcttgttgagtcttacctttcttcttctcctatgctatatctgtcctaagtcacttgcatttgtctgaaccatcagaatgtcctatagccaccatctagttatctctcactagaaataatcatttatactcttcaaatctattttaattgaaggacagttattcattttgcaactcaagttcaaacttcatctccatttaatcattttgttttatttttcttgcacaagcagatacatatccaacaatttattctatattttgtttacctttgggtactccattggtgtagtttcattattaattcatctctctactccctacaacctaacagagagccaagcatatagcagatgcttcacaggtgactgaaaaaatcaggcggagaggcacagaacacatagagataaaatacacatcaataattcagatcaacctcttctgatagagtttccttttacctttgaggggaaaactggagtatatttcactctcaaaaactaccaaagcccagaaagagaaaagatatggagaaatcagaatgtttaaaaaagtttatggaatgaaaagtatattaaaaaggtgttgcatatttaatggtatcctcattttacaaatatttcccatatcaaaggttagcaaaggaaatgtagacagcaaaacaaacaaacaaaaaagcatgtgcgatttattaccaggccagaggcattcccatgtaaatttagttcttccaacaaccagtatatgatttagaatggaagaattgattgggaactttttactcccagatgtgtggcagaaagcagaagagacagtatgattagttgttgggctaaaggtttcttatatgaacagagtttttgaacattcgtgacccacttttagtgctgagactgggacagtcttgagcaagaaaagggtaatttgtcatgctatgagaatcctcatgaaaacagctggacttaggaaattctaagtgtttttcataaaagctcaaaaatgttcctctcacctcctaggatcatgtcatttgaaacttgatactttcagatagtcttgtcagacttcctgttctatgttaaagggcagatttccttggaaatcctatgttttgatgtcattaacacattgttaatgttaattcttttagcgactatttactgtttaaattatctatgtataatgttatgcattagtactgtgtgctaactggtttgcaaacattgtttcatgtcatgtaaaaggctaatgaagtagtcactaatattatttttgacatgagcaatgcaaagttaaataaattaattttccaaagataacagacctgatgaataattattcctatgtttaataatggttatataggttgggcacagtggctcacacctgtaatcccagcactttgggaggccgaggcaggtggattgcttgtgctcaggaggttgaaaccagcctgggcaacaaggcaaaaacccatctctacaaaaaatggaaaaaatagctgggcatgttagtgtgcgcctggagtccgagctactagagaggctgaggtcggaggattgcttgagcccaggctgggcgacagagtgagaaagaaagaaagaaaagaaagagaagaaagaaaaaggataatggttatatattttaatcataagatatctgaacttgaatacccggacattctgttctctgaggtacattctaagtatgaagcatcttgctggatactctgagacttttcaatatccatgatgcactgtgcttaagatgtttactatcttatggctgggcgcggtggctcatccctgtaatcccagcactttgggaggccgaagtgggtggatcacgaggtcaggagttcgagactagcctgaccaacatagagaaaccgtgtctatactaaaaatacaaaataagctgggtgtggtggcactggccagtaatcccagctacttgggaggctgaggcaggagaatcgcttgaacccaggaggcagaggttgcggtgagctgagattgtaccattgcactccagcctgggcaacaagagtgaaattccatctcaaaaaaataaataaataaatagaaagatgtttactatcttacatggggatacaacatgcagataaatagctaagatatcactgaaaatttgcatagcactttggtgtacacaaccccttcacaaatagtaagtgaattgaccattctaatggctcattaaaacaagcataacaggagtttataatttccatttaatagatcaagaaactgaggttcagataaactaatgatgttcaatagctattgatattgcagcggggtttaaaatccagacattttccttataggctgatgttcattttactttacggtgtggcttcaaatacacattaccaagtcataattacattatagaaatttccctttggctcatgaattccagcaacctttgtgatttgcaaccccagtcacatcatacttctgaaacttcataaatgttttttggatgaatgaatccacatttccagatagtctcacccttagaatttattttatccacaatcagtaacaatttagagacccacaaagcaatcaccttattcataaacagaaatgaacatcttgaaaagctgtaaagttgagtggctaaaaacccttgagcgagactggctttataatccagctcttcagctctctgcctgtggtgagtatgaggaggttacttaccataacatttcttttgaacctttcctcaatatctcctctggtacaattagagtaatattctatgtatctcaggaggttgttatatgaattgaatgaagtaatatgagtacacatctgagaacaggatctggcacttagtaatatatatctcagctactattatcatggacataataattattattttactcagaaaccaaaaaaattaacataggttcagccacttgttttatctgggaaatattattttcaccaagctaaatttcttcatctacataattggataatagtcaaactaatatactgaaaacacttgttcagtgttaacccgatataattgtccaataaaatttctatatttttatttcattttaacaaatattgtgtaaatactgtataccaggtcttctggtagtcactggggatagaacagcttttaaaacaggtaaaactcatttttttcttttattttaatgggggatacagacataatacagaaataaattattttcacaaataaattacatatactgaatctatactcagccagaacacttagagctaaaatatgccacatataatttatcattcatttaacttttgaattatggtgtttattcagttgtctgtacatcctataagtttgctaagggtataaattagagtttcaactcagagcaaagagaccactttacagatattatgttttttaatgattagcacttaatttttttagattagtgatggtaaaacaaaaatgagatcacttctaatgttgctgacagagtcccaaacccaagtattctgagtcagtgtattctataaatccttttaataatgaatattaatgattaactttattaaagttattagagccattgatgacttttccaggtataaaattatagagtcattacattttaaaatacaatcataaaattatatgcatagagggccatgcagatacaattttgaatatgaaactgtcacagggataaatgttagctagcaaaatctacattaatgcaagcattaacgttctgcaagagacttccagttcaggctgggctaaattgtgatcacagtgctaaatcacttggcaagagaccgaataacctaactgggattcatatatttcttagaagagcttcctgttatccctcacctaaaagtgattttcattactaagaacacttaatttaactctgtatcagcaattttcatattgggcaactatatttattataattgaacatttatatattctgcagattgctaaaacaatgactctcttgccagttactacatgaagagatatatatttttagaaatgctgatttgaatgttgtaattatcatcatacctcaagcaggaatgcccataatagaacaactatttaaggatatttcaattaactactttatttttattcaaaatattgtttattttaaaaatgatatgcaacagatcagcaggaattggtcgcaatgagccacaatattttccacaattataaatatatcacatttatttgcatttccaaaaatatacttttgatcaaaaatagtaatccaatattttatttgactttccccagtgttgttttcaaacagtggaacactttgttattcatttgatagggaaatatatagtttaacaaaattttacataaatgtatgtgtgggatgtgttacgctgggataaattttttgtaaatatagttttggactgaaaaaaagggatggggatttcacttatatttctaatatgtgtctttttcgcattcatgactttacatttcatttttgagagctacatagttttatgatctctagaattgtattgggtttttccttctttctctcttttttatgtccaagcttgcttgtcctgtgatatcactgtgttgtctttaacatttaatactgtcattctgtgtccagctaatgcaatgttgtcacattcacatagagaaaggaaaatagccagtagcacagtatttagtaaatgccccaaatgccatgatctgtgctttttacagtgaaattaaaagtaggttattcttaccaaaaaagacacacacacacatacacacacacacacacacacacacacacacacacagaataaaaaactgaattaaatgcatcttcatttttgatatttctattttccttgattttattattgcacggaatttaccttagtctgtatgtacttccctagtcacttctttttcctatttttttgcaagacaataacaaatggttgttaaggactcagaagcagaaacatttgtatacaaactccagttgttttaatcttaacagttgtgtgaattgcgcaagtgatggaagccttaattttgttgtgttatgtgcaaaatttagataataaatattgccccctaattaatggcttactgaaaggttaaatgtgataatgcatatggcatttttagcacttggtgaacatcactaatacatgtgttatcattgacttgtgcccctcttcctattgttgaaatccaagcattatttaaggttctaccatttattgctctcttctatttttatggctttagtatgtagctccactcattgtcaaaacatcagtaattccaatatcaaaacattcttaatgaagtgatattaaaacaagctttataaaacttcatcttaggattaaagtggtatcactgattttaaaagtttgagaggtaaaaataaatttgttattttagaaacaaaagataaagaagaaaatgcattatttggtactcactcgtatttatattttcttcggtaagcttagaactcacattagttcagtgactttgaaagaatgttaatttagcatttagcctgcttggtatttggaattaatgaatataaaaattaataatcactttcatttgtcaccaaaaatgatttcaagatatatctgctgataaatagaattgccatgtatagcataaatttctatatgagaatgtccacagaaatgatttcaatatatctgctgataaatagaattgccatgtatagcataaatttctataaatgagaaactcagttgtcacctaaattattgtagatacatttgccttaaatcaaagaatgtatagaaatgtacgatataatcaagtttttgaagtctttgtaaaaaagaatatgtaaattgatgatatatgcaaatagtacttgagagtatatatattaaataattgccttaataatatgactggtctacttagtttgcaaggttagaacactagaaatcaattaaaattccttcctttaccttatccttctgtctgcctgttcaaacattgcttttacatcctaaatttctcttaaatccactcaatcctctatctaaatgtatttagtacattatttcagaacctcatcagttctcacatggaccaatgaaatattattaaatccattcttttgtttttatttatgtcttcttctggtgaatctgccaaaggattattctagagtttacatattcaggattctctctcagatttgtaagtacgtggctttgtaatgtcaaacgtataccaaacattttagtgtggtagttctcaaactttaataggtatcaggatcacctaaataattttggctgggtgcggtggttcatgcctgtaatcccagcactttgggaggccgaggcgggcggatcacgaggttaggagattgagaccatcctggctaacatggtgaaaccccgtctctactaaaaatacaaaaaaaaaaaaaaaaaaaaaaaaaattagcctggcgtggtggcggacgccagtagttccagctactcgggaggctgagaaaggagaatggcgtgaaccctggaggcagagcttgcagtgagccgatatcgcgccactgcactccagcctggtgacagagggagactccgtctcaaaacaaacaaagaaaaacaaataattttctgggattattttccagagtctcttatgcagtagttttgggtgaaccccggcaaggtgcaattctagcaagtttcctagtgatgccaatatagctgatcctggaaccaaactttgagaatcattgctttaatctaacctaacacattctccatgacttctctagcttgtttctcaaacctaatctctcatcactttctcaaacttattcacatttcacataggcctaaatagtgtgagctcttgtacatttccatacaggatcgtatgttctttctggaacatcctttatttcactactccattgctttgcaactttgtttacctgggttactgataatccaattcaggattcagcacaaacatagtcttgtacaccttcccaaactcttattttgtgtaactttcgcatatgtaagggagtccctgtgcatacatatgtcccaatacttaccaaaatgtaattagctattttttctgttttgcatacaatttttgtgagctcctcatcttatatatccctatatattcagaaacgtatctggcaatttgactctatagatatttatcataaagtaaaatatgtacatgtcaatcactggaaggaatattaaaaataataaataaaaatatatccattacattaatggcatgcttgtgtgtttcctcctttaatagtttaaggatattctgattttttataaataagaataatttcttatatgttgtgaattttagcaatgacattaaaatattgatgatattatatagtgtgttctatataatccttttttagggtgaggccaaattatatttgctgttttatttttcttatctagtatgtactgaagtggtaagaagagatcatatttcttatgtattaagtgacagttcattaatttactaaattaaggaatatgtatcaaaagcttactatgtagcaagcaccatttaaagttatgtaatttccccaaactcaaagagataaaagtaaacagtgaagaagcaggtcagtatatctgacccattgccatttcactatctgttcttctccctatgtgctttggttggtaaaatttgtgtcagaataccagcttactaataaatgaaattgacctgcaactctctcaagaaacatttatgctaagtgtagctcttagcagaagattacagctactgggaaattctcagcaacagagaagaggatgcaagtgaaatgaaaagcaattgggcagtctaattgagaaagtaatgatgatactcagtatgaaaatagatattctgatggcattaccttccctaggatattctcatactaatctatgatatttctaaagatgtatgatgtgttttcactatctttaaccataagtgatgtagaaaacatttaatagaataacaagaacaattttcaatgtgtacataaacaaaaaattttgaaaatgaactcaaaacattcacagaaattttttcaagtaagcttgcaaagtagaacagaaatatcttaataattattagatttcacccaatatctaagaaatagaggtggggcataaactttttatacatatagaaatcataaaatgagtgatttattctctatgtcaccaacaccctatatttaatataatacatatgctaaaaggatttatggagaaaaagtaaagtattactcataaaataattactatgctgaaaagggatttgtgaaaacaaatcctgtgattacagtgtctaatataatatattttcgattatatccctttctactaatcatttccatatgaaccttagctttacatttcatgattataaggacagatacttatattgtgattagcccacaagatgggatttataatttaaaattaaataaaaattctagcctattagggataggcattcaaatatatattcacttactactaataatgtagaagttgattttacttttttttgagacagagtctcactctgtcacccaggctggagtgcagtggcgcgatattggctcactgcaagctccgcctcctgggttcacaccattctcgtgcctcagcctcccgagtagctgggactacaggtgcccaccaccatgcccggctaattttttgtatttttggtagagacagggtttcaccgtgttagccaggatggtcttgatctcctgaccttgtgatccgcccgccttggcctcccaaagtgctgggattacaggcatgagctactgcgcctggctgattttacttattattgaaaaataatttcacattttttatgatgatgtgagaatatgaaaataaaatgaaattatagtaaatacattgatagaagattaagttgataatttgcatagagcatattggctgggtgcagcatttgtaatctctatgttccttgaccgagggcatggatgttcacatttatgctgagaatttaattgtaagcagaatgttgacttttttctcctccctgcttttgctattctcagattaaaatggcatttcttgccctaacacattttgtttattcatcacatttttattgttactagttttatttgtagttaagtaagtctgcagaaatcttcctcccaaactgttctcccttaatcagagattcctgctgatcccattgtggtgattagttaagctaatgactgcttgcctttagatttgggtgcagggagaaacacatttaaaactcttgttatgaaaccattaaattaatcttaagatactcatattaatataaaaattagcttgtcatttcattatcagtcatgtcctcagctttttaattttttggccagtatgtttctcaataatgcctagcttatttgactcatagatccctaacttcttgaccaatgcccctcaactctgctgtgatctttatgatttcacctttataagattctgttttctgattttctcctgaatctttagattcaacctatttgcctgctatttgcttttttcaatacgatactattcacattttcagattacacctgaatatggtttggctgtgtctccagccaaatgtcaacttgaattgtatcttccaaaattcccacatgttgtgggagggacctaggaggaggtaattaaatcatggtggctggtctttcttgtgctattctagtgatactgaatacatctcatgagatctgatgggtttatcaggggtttctgcttttgcttcttcctcatttttctcatgccattgccatgtaagaagtgcctttcgcctcccactgtgattctgaggcctccccagccatgtggaactgtaagtccaattaaacttcttttggttcccagttttgggtatgtctttatcagcagtgtgaaaacaaactaatacagtaagttggtaccagtagtgggatgttgctgaaaagataactgaaaatgtggaagcaactttggaactgggtaataggcagaggttggaacagtttggaggggtcagaagaagacaggacaatgtgggaaagtttggaacttcctagagacttgttgaatggctttgacaaaaatagtgatatgaacaattctaggctgagatggtctcagatgtagatgaggaacttgttgggaactggagcagaggtgactcttgttaagtgactcttgttatgttttagcaaagagactggcagcatttagcccctgccctagagatttgtggaactttgaacttgacagggatgatttagggtatctggcagatgaaatttctaaggagcaaagccttcaaaagtgacttgggtgctgttaaaagcattccattttaaaagggaaacagagcataaaatttcagaaaatttgcagcctggcaatgcagtagaaaagaaaaatccattttttgaggagaatttcaagctggctgcagaaatttgcataagtagcaaagatactaatgttaatccccaacagcatggggaaaatgtctccaggccatgtcagcaaccttcatggcagccgctcccatcacaggcccagaggcccaggaggaaaaaacagttttgtgggccaggccaggctccctgtgctgtgtgcacccttgggacttggtgccctgtgttcctgccactccagccatggctgaaaggggccaatgtagagcttgggctctgggtttagagggtggaagccccaagccttggcagctttcacatgatgttgagcctgtgggtacacagaagtcaagaattgaggtttgagaacctctgcctagatttcagaagatgtatggaaatgcttggatgcccaggcaaaagttttctgcagtggtggggccctcatggagaacctctgctagggcagtgcagaagggaaatacggggtcggatccccacatagagtcctttctggggcactgcctaatggagctgtaagaagaagatgccactatccttcagaccctagagtggtagatacacagacagcttgcaccgtgcacgtggaaaagcctcagacactcaatgccagcccatgaaagcagccaggagggaggctgtaccttgtaaagacacaggggcagagctgcccaagactatgggaacccacctcttgcatcagcatgacctggatgtgagacctggagtcaaaggagatcattttggagctctaagatttgactgccctgctggatttcagactagcatgggccctcttacccctttgctttggccaatttctcctatttggaatggctatatgtactcaatacctgtacccccattgtatctaggaaataactagcttgcttttgatattcaggctcataggcagaagggacttgccttgtctcagatgaaactttggactgtggacttttgggttaatgttgaaatgagttaaacctttgggggactgttgagaaggcatgattgattttcaaatgtaaggacatgagatttggaggggttgggatggaatgatatggtttggctgtgtccccacccaagtctcaacttgaattttttctctcagaattcccacgtgttgcaagagggacccagggggaggtaattgaatcatgggggccagtttttcccatgctattctcatgacagtaaataagtctcaggagatcgtatcagttaatcaggtgtttccacgttttcttcttcctcacttttctcttgccgcggccatgtaagaattgccttttgcctcctgccatgattctgaggcctccccagccatgtggaactataagtccaattaaacctctttttgttctcagttttggttatgtcttttttagcagcatgaaaaaaaactaatacaacctgtttctagattaaagtatattttgatggtaacttaacatttagcccagagttgatactgatgtcaatataaaatctgaagtagacatagaattatggtatactttggggtaagaagtggaagtacttggaaaaaattcaacagataagcagtcaattagcatattaaactatatagtatataaaactattcattatagtaatcaatattacaaacaacttttctagggaatctttgaaatgatgaatgctcaaggatcctaagtatatcaatctatacaatgcaaattttaacaacttatgtaagcaattctacatctatctatcatgaacttccattatgaaaaacatcacttttagtatgaatatcagagtcatctaaattttacagacaaagaaatcgattgtggaataaaatttttcaaccaaaccaaatgtttaaaattttgctcatgtttttcgtttcagcaaataaaagcaataggtctcttttcttttcagcattcaatttttcaattgatttttattgatgtgttatggattatttttctgttaaaatacatatttttaaacccttctgaactttccaataatactttaatattattttatatcagttatattctcataattgagttagatcatttcctctatagtttaataaaccactgttagaatattttttaaatgctaataacactctatctactgcattgtactacattttgcataacaattatatattaaaatacttttctaatattgattttctaagttgattttctaatatctaattttctaagttgaaatttgtcttccccatcctcttggacattgaataaaatgattactgtgaatatcaacattttatattccttaaatgtttgaagatagctttcatttttctcttctatctttatttcactgggctaatcattctcattttttctcttctcgcttttgactctcatcatcatagtctaccttgtgtcggggctgttttcaaataaagcaggttatgcacaaaattaaatatattgtgattaacaactttcttaatttgaactctgtatttcaacaaatgcaactgaattcttattagattcatggtaataagtttacatttgtttttaactaaaattccctgaagcttgttcacatgtgctaatggtaaatcccacctttcccattctgtcttgcctgttatatccctatccatttgtcttcttccctctcccttcctacttgctttcctctctcttcctcccttcctttcttctttcttctctctctttattcattttcttcctattctctcttcctatttagttttctcctttatttcctccattttgttcttcctttctttctgcatgaccactctgttgacaaaagtcaatgatagcttagattgacataaagcagccataaacagcaatagagtatatcaaacagtgcatttttataaaatatgaagaaggaagttagtatggtcatgatatataccagtgagagctacaggattatctaaatcctcaccatcatgtagacagttactgattttatctgagttagggatacatagatctcctagaaaattatctctgcaacttccagacccagcactatatatctatacattagaatggaacagcttttcaaatggggtagtttagatttgtgctagggttatctctggggtgtattctgattagacagtactataaaaaactgtactcttaagcactgttaccatttttcttcatcatgttcagttttgccaggctacactacttggtaaaagtagattcctgattttcattctgtggaactcatgctttatgttttcacatatattttctttatacactttgcatttctctcctatatttttcatattattgtgtttgtttttgatattttgtttgttctggaaaggatctgtatctttcaatggactcagcatctgtttccatcttcagaagaaactatttagaaaaaaatacagatctcaaaatgcaagaactgaggactggctctgctacatattagccctgtaacttgagctagttatttaatctctcctatgcttcagtttcttaatccgagaaaaggataaaaataataccaatctcatatatttttatgataattaaaatacatagtttatttccagtatccagcaaactatctgatacagatacagaacttaatagaaatagcaattagtttgatcaatttgccattgttttaatcagctcaggctaccataacaagaacatcataaattgagtggtgtaaacaacagaaatttacttcccccagttctagaggctgggaattccaaaatcaagggactggccaatttggttcctggtgaagtctcttttcctggcttgtagagggtggccttctgacttacatactggcttgaccttaccatgctgtatgcatgcaaaaagagagataaatctctctctctcgttcttcttataaagccctaaattctatcaacttaagatcccctctatgacctcattcaaacctaattatctgctaagagctttgtcttctaataaaatcacattgagagtttgggcttcaacatattatttggggggacaaaattccacatatatcagttatcaaatcactccatcaagccatttaaaaatattgaagagaacaacgatttggtcgtctgtgtgtattccatgtgtatattcatatacagatcacactttcagacacacaaatgtgaattctcctcttttcaccattcactaatcactaatcaatttttattaggtattttgttgtagcattgatttttttgacatttagaaaatgatattccatttctttttcttactataattactaatcaattaaaacaagtttttggtctctactaaaaatacaaaaattagctgggcatggtggcggctgcctataattccaggtactagggaggctgaggcaggagaatcacttgaacctgggaggcagaagttgcagtgagctgagattgcgcactgcactccagcctgggtgactaagtgagactccgtttaaaaaaaaaaaaaagcttttacttttatttactatgtgccaggacattattctaagaatttttacatgtaacaattaacttttacagtttttatactcctttgtcttcttttctcgaaattttaataatttctgtgtatcattcttgggtcacctcttgctgtgaggctacagagaggggtggaaagggttattagttttgaagtcaactggatatacattacttagtttgttgaataaattatcacattttctttttttttctcttccttccattctcctttcctttctctctttgttggtttcttttacttttgttttcttctttcctacactgttcctgccttatttctttttctcctgttaaaaaaaaaaaaaaaaaaaaaaaaaactatgggaggacattgttttggaccagcctcctgcactaggctcctgaagaccagaccaaacagaatgcagtaatttgtgctaagtatatataatcaagctgaactttaaaatgggccagttttcagaaaaaaatctggatattcccgtcagcctacgtcaacataacagaaatagttcccactctgtcttaacgctgtaaggaaagtcactttgaaattaccaatctacttttcgtttcctgtttctgtctcttcagcccttttctgcccataaagccagcttcccctgctcagctcattggaacactcattctaatttatagaatgtggtgttgcccgactctggaataacaaataaaagccaattagatttttaaacaaaatttgttataattttgtcttttgacactcctttcctccttttgtgtgactatattcattgttatttccttacttgcttgtctttactctgtgtaggtagtacagctttacttcttatatttactatcttcattttggtaagtaatttaaccttttcataatttttaaaaatagggataatatatatggtatacacaaaatatgtctgatacattgtaggcaattcccaaagtttattgagaacagtttagtacttgtattttaaaattctctcattattctgaatgagacttttgtgagtaatcagcatttagcaagtcttgggagcacagtctttcaggttctctgtagatatacacataagcatatgttctttaaaaacaaacaatgataacaaacaaaaaagagcatagtttcaaacatgatctaattctgccccattctaattgtggatagtcactgatgaccaaatatcacttaaacatatatgtgacatctttactttgacttgaaatcagcaattaactgcagattgaaaaatttgaatccatatgccaacttaatttacataattaaattatcttaaagattctctctaatatttctctattttattttatctttctccatcaaacaacttttattgtaagaacacgagtattttacaaaatgcagaaccaaatcagcaaacacatttcttaggcaaagagaagagagtcgctcaggaaaatttaacaggtggtattttaaatacaatatacaatttcccctccccaccccagaaaaaaaaatggcattaaggagacttagcagataatcactcagtcttgatatctattttcaacatataaaattagtaagacaaagcctgattggctcaacctagatgatttgaaaagaatgaaatcatttagctatggccaaaggactcaggcttataggagagagaaggatacagaaaggtctcaaagaagaggtacctgttggatagactaatcagcctcacactagtgccttccaaccatagggtaccaataccatacctactgtgacatatttgacatgtcaccatatgtgaaatttctagatccttttttaaagcacaaatgcaggtattataaacaatgaacccaagttcaagctagcaccaatcccaaagtcacatccccaaaaggcaaatgtgttcatatcaattaataactgacatgctgaggtcactcactgagtttaaatcattcacatggtgtccgtggctttcagagaattgttgtgaccctttcagattcagaaacctatgggctaaacattaaatgtaaatgctgcaaatacaaaactttacatactaattgaagaaccaagcatgccaatttaccaagctgcaaaacaaattgctcattacccctaacagacaaattattccccttgagctctaaaatctaaaaacatttgagtgaggagcactcatctttaatcatgggagattcaatgctcaaccacgacccctagttgcacaggagaagcatacatgcctaggtcttgcctaaaaccatattccacattctttgggtcaacaacttgactgcacaatctgtagtttcaagcttatcatgagtagagtctgcaataggcctttcctgtgttcgtaagaccagttacatctaactgaagggaagaataagaaacagcctgctgttgttcttccctcaaattaatgaacaggagtgcagtgggtcttcatgtgaataagaagacaaaagggaagctcagcaaacctgcttaaatctatagtgttagcaggccagcttggcagccatgaataatctatatattgtattactggagtgagcacaatgggctaagaaggcaaaccaaaatccagacacatctaaggagataattcaaagtgtataggcatgcacacattctgcacattttttttcatgctctatacgaggcttttacactaaatttttaaaacacaggatgtgattcctgacattctatcaaccattttattaggtgatatgtatcacaaatcataaagatcaaatctctactatagccctaccaccctgaatgcacccaatctagtctaatatttctctattttaattccacacagctggagccctccattattataagtttgaagttttgcaaatcttccctttttgtttatttagtaatatataacgtaaaattcagtccttttaaagtgtacaatttactgaatcttaatgaacttatacaataatgtaaccaccaccaaaataaaaatgagaaatatttccattgtccgaaacagggtcttcattaccctttgcattacttttttcctacattactccaagaatgtggcaactattggtataatagtttttagatttgccttttctagaatgtcacataataataaatctttccttttagatttgccttttctagaatgtcacataataataaatctttcctttctatagtgactagttcattgttactaaaaaagggcctataacgggcaaataagcagaaaaaaaatgttctaatcagacacaatgctactacttggctgttaggcattgtgtcttcctgccttccaactgcaaaaaaaaaaaaatgtcatttttcagggctctaggcttgaacgtattaaagattggttgtttatctaaggtgcgcttcactaaaaatatttcatacaaatcaataattagttatctcaagattttcaaagatattcttgaattaggaggaaattctctcgacaaatcaaatgttcaccaaaaggccattttatctgatggttcctagatgaggtgaccaaagcattcacatccaaagtgtactgagactgaggatgagatatgtgtcctgctgagataagaacctgatgggcctttgcctgtcttaaagtaaattccttttagtagagattgactttctcttttctgctatgatttttctgctcaagttatactagaaaagtatttttcaaataggagtataaaacaactagccagaatgatgatgagaaatgattaagaattctagtgattttaagggaatagagtttatattatccactccagcatagtgatggttttctagtgggaaaaatagaactggaactgcatatgttgtgatagtttggtggcaggatacaaaagaaattctttgaaacagcatttaaaattccctcaggagtataaacattatttcttccttgcctgtgggcagcagagtgtaacatatgggacatacatgcaatatgagagaaaactgacaaacaggagggacatgttctttccctctctgtggtcccagtttggtctttagattcttaggcactattcccactctagacaagctggaaatagatttagaatacagaaacatatgcgttagaggaatatccctagaactttaaagttcaaaagaaataagaaattatgtagcctccatataactctatacaagttgtattagatgtgatattttggaagtttgaacaattgatttgtgcattttactttatatttatgaccttaaggaaaattcattaactagtgtgattttgttaactccctaactgctgataaagagcaagggacactgtgaactttcgattcatctgagtttattggaagggaaaaaagtcactaaaaatccatgataataaaattacttaatgaatattgaataacctatgataagttattgatataaatttagtaaatgctacattttaaataaataatataaataagtttataaataatgcctttaagtcaatcataaagcatatgctttaaaataagagtggttagggtaactagacaggttttgctatgttttatgtggagatagaggagtgtattttagaaattgatgactttctctgtaaagttaagtcaagcgattattttaattttttccctttatggttaagactcataaaatattgctttatttctagaaatagcgttgatttttactgtcttttccttttgaaaactaacactccaaagagaacactagacttcctgcatcgcttttcaacgtctcaacccattttagaggagaattctgcccaaaacaccttaaatttctcataaaattatttttacattttgttgctggtgaaatgtcacctaaaacattttaatgtaaattatttgttaaggtaactggattctcaagatgtaatatatttatgtctaacctatagcccttcatagtacagtagcagcctcaacttgtaaaaaaaatcacaataagctgaaaaaaatacaaaacgaaattagcattgtgacagcaaaaacaaggagcactaggaaaatcaggaaattgaatgacactgaagaacattgtatttttaaaaaatttttctattgtagtgcttcttagtaaaagttgaaattaaagctactgatttcctattagcaaataagggaaacagtctaagagcacctgaaaactggaaaatcttttatttcttaaaagctctttacctttgaaaacatcttcatatgcaaacttataaaccccacattttaaatgacaaatccaattattttctttgaaagcaaaacaaaaactaaaaaccaaagagagtactgaagttgtggaaaaacatgggtagtcttgtagttcactctctaagtccttttgtattccctccaaagtcattatttgtggtttcagatagaaaatacattcaggcagcaaatcatgttccttttgatggtataatgtgataattctcaaaaggatctcagcacccccttgttcatatttatgcaattaactagtactttaaatgcctaatatatctcaaaatgaaggctaaatatttcattttaataagatttcatttgattggaattttggttgtgaaggacatttgatgacaccttttcttttcatgtctaaattgcagcttatcagtgggaatttccacttagctctcaataaatttggggaataaatgccaaaataagaaaacattaaggaaatggaaaagtcctaacaatattatagggttgatagcaccttttttattacaccagggattactgaaaggcaatgcacttttcacatttttctaagtctttatttgctattacagtttaaaaaatcaattagaaagattatgtcattcaataattatgatcaaaagtaaagaggataattcaacttttccaggttttctttgataatcaaattggcataattaaagtgtgtttctcctgttaattgcaatattcaagtaacaataataaccattaatgaacaaattttcacatttatgaatggtataatttcatcagatcatacatcattcctttaaccatctctggagttgttatcagtctttgctgaccattgctgccctcaaaattgctttcctcatggcaaatatagtgtttctatgagaattttggcttgaatttgcaatagcacatgtgacacctatttgaatatatggtcattttttgagctcacaattttacttctaagtaaatactctgtgatgatgaatattacacatcaatttggctagattaagacaaataacgtgtctttttttggtcacacactagatgtgaagatattttgtagataggactaatatctactttaaacaactctaccttaacatttattttaagttgatttaaagcaaagagataatccttaatttgcctcatctagtcagtcaaatgttttaaaagcaaaaaccgaggttttccagagaagaaggaattctgcctcaagactgtaacttagaaatcatttcccagtttccagactgccagtctgtgctaaatgtcaactcttagctgagtttccagcctgctggcccgcctcacaaatgttgaactttccaggcactacaatcaggaaccaatttcttaaaatcactctctctctctgcacacacacacacacacacacacacacacacacacacacacacacacacacccctatagggtctgtttctctaaagaatgctgagtgatacaaattttggtgctgggaatggttctagaaggacagactcttcaaaataaattttctgaattgattctgggattttctagaattggtgctctaatctggttagatataaaggtaccaatggctctatttctagtagtaaagagagcactgatgttttgtggtgtgacgtggcaagaaaactacgtgaaatgtctccattgaatgcaatggaaatattcaaaatacattgaaaatatctcctaatcaaatacaagaggaaaggttctggatgatcatgtatttgatattttaggacattctgtcaaactaacaagtaaaatgagattagctgattgctcctaattgttctggacaaagtgggtacagaaaaggatgagctcatggtttcaaattcccagctcaagtacaacatacatgatctgaaagtttctatatctatcctgaaaaacaaaaaacaaaacacacacacacacacacacacacacacacacacacacacacccttatctcctgtagcaaaattcagctacttacaggataagactacttatgggttaagtttgctacaggagataaaggtgtgtgtgtgtgtgtgtgtgtgtgtgtgtgtgtgtggtgttttcaggatagatatagaaactttcacaatagcaatgacttggaaccaacccaaatgtccatcaatgatagattggattaagaaaatatggcacatatacaccatccaatactatgcagccataaaaaagggtgagttcatgtcttttgtagggacatggatgaagctggaaaccatcattctcagcaaactatcccagggacaaaaaaccaaacaccgcatgttctcactcataggtgggaagtgaacaagacaacacttggacacaggaaggggaacatcacataccagggcctgttgtggggtggggggaggggggagggatagcattaggagatatacctaatgtaaatgacaagttaatgggtgcagcacaccaacatggcacatgtatacatatgtaacaaacctgcatgttgtgcacatgtaccctagaacctaaagtataatagaaaaaagtatataatgtccaaaatcaaagagtgtctgctttaacattagggcactgattaggaagaaatggaatcctcaaaattagagtgggacatattttgatcagcaattttgatgaagctgaggacactgaattccaaaattctgcagtcatctttagcaacagcccttccacacctgtttgaggacattacagctgccttccctgaggaaattaaatgaactttgagacgccttgcaagactttactaattctactcagaatccacccccatcacccaccttgcttgtagacctctaattagactcaaatcctagatgagccaaaaaggtgaagtgcaaagtgtggcccatgaagagttgcactatactccaaaagaaccacatgattttttctaactcatacagagaaatttgaggaatgtgtttattgcttaatattttgggtgatttttgttgttgttgatattgaggtatcttctacatccttatggttttttgtcgtttttctatcaacaagtaaatgatatgtgttaaaatctcccattatgatggtaagtttgtctattttcatttttagttatatcaaattttctttaggtattttatagatatgttggtatgttcaaacttagcattctaagcttttccttggataagttattgtagcattatgaaatgtgtcatcatctgatattattgctctatcaaatctttcttggggttgtgcagcttatcttctattactgtttcacttcttacttttgtatatatttattttcagttgtatctcctgtaagcagcataaatcaggtttttttctattattttaaacttcaacttttatatggagtgcttaatatattcagatttaataaaatcagatatatttgactttaaatttaacactttattttttcattgtttctatttcttttgttcctttgattatctttcttagaatgaaatccttttttattttccactttattagcttatttttacaatattttgcctttacttttagcctaaaaattacagcatgcttccttgttttaatatatttatataaattagtacatttttcactttaaacaacataaggaccatagaacttctctcctcacttgccccactattaatttatttttattttttcctaagttcctagcttcagtgttatattgtcatgcattttaattttatatttatctaccagtatcattggtttttattcctccctgtatttctgtgttttcagttgcaattattttcctttgcaggaaaaaaactcactttacttgaagctgctgacaacaaattctctcaatttttttgatataaatttttattttctttttatttggaggatgttttcttttaggtacagcattctagtttggcagttttattttttagctctctagtaacagcatcatattatcttctagtttccattgcttatgttataaagtcagctatagatgacattgttgctgtttcaaagataatgtgccttttgtttaaatcaaaatattccctatgtatttgactttcagtaaattgaggtttcatttgtatatattctgctttaggtacatagttccttttaactttgagctttcttgtctcattattttgggaaaatttctagccactgttttcacttaacgcttttgtttccttcttctcttacctcacatcatatcatcttacctaacctcactttctcttatttctctctttccttttatttgggggtatttagaagagatgctaaaccttttgatcatgtctaataaatcttgtatgctttgtaatgtatttttttctgttatctactctattttctgatgactcatcttcctgttcactaactcttactctatgttcttaatgttatttctagaattaccatgtgattcatactatcaatgcaagaagtctgctgacagtatcgtataccttgttgtatacattaatcatagttatttaaaaacatctaaaaagtccaataacccttgtttttttttatcactgggtttcagtgacatagccctgcatccttttaaatctgctagtttttgagaaaatgttgaatacagtgtatgaaaagttagaaaggtaatctgagattttttaatgtaggtattttcagccataagggattctcttttgtttttaggaggcaggagagtaggagcaaatcaatttttttttttttttgagacagagtttcactcttgtcgcccaggctggagtgcaatggtgcgatcttggctcagtgctacctccacctcccaggtttaagcgattctcctgtctcagcctccctagtagctgggattacaggtgcctggcaccatgcccaactaattttttttttttttgtatttttagtagacatggggtttcaccatgttggccgtgatggtcttgaactcctgacctcagatgatccatccgcctcagcttcccaaagtgctgggattacaggcatgaaccactgcgcccagctggagcaaatcaatttttatcagcctgtgataagattgattcaaagttggatttctgcctttgcaaatgggcttatttgggtttgctctaatgccagttgaaagcctgaagtgtttaccgaagcccatcttctttggcaggtcttgaactaaatgtttgtctctgctacccatgaaactggcaaacctccattcagcttcttagcattttggctaaaattaaaatatcagcaaatgtgtagaaaagtgccaagtgttaggctcccctctcagcactcctcttgctttctgggatcttggtgcctcaagttctggctgcattggtaaacatcaatccttattttcacttttcttatcccaagatactgcccaaagctctgattgacttctcagtatctggaccctttacataaataagcaagggaaaggtggcacagaaatttggcactgcttggtataattcttctctgcaagttcttggtttctcaagggctggttgctgaagtagttctttaatattttataataattaaaaccatttttaaagtttttataattgttcttcgtgatctgttttgtcttctataggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcacagttgaagaccatattttcagtttcatatcggcatatcccatattcatactcagcctctggcagcacactcctaaaatatatggtcaaagcacaaactgaagaataaacaagacgatcacttcacctcagtttctttttcttcctttttaataaacatttgccaaataactgccatatgccaggtacttttccatggtgctgaatgtaaagagaattacaaattgaattttgggtatttagtaggagggttaaatagtaatgtaaaatctaaaaaatctttacagttatagaaaaaaagagggaaagaagaaaccattaaacagaacctatgttggacccttttttttctttttttttttttagctcgcttaatctttgcaacttaatgaaatagttactattatcttcattttagaagtgaagaaagagaggctcatatagattaattatctttacagtgacatttcgcatgcatcaaatgccaaagactatttccttacactctgctttttcttttttttaaattttacttcaagtcctgggttacatgtgctgaacgtgcaggcttgttacataggtatacatgtgccatggtggttcattgcacctatcaacctgtcatttaggttttaagccctgcatgcattaggtatttgtcctaatgctctccctcccctttccctcgaccccccgacaggccttgtgtgtgatgttctcctccctgtgtccatgtgttctacactatgcattttgaagaatgaatacaagtttgtcaggtacaaaaatacaataacactctaatgaagaaggagaaaggaaaaaaaacagcatgaacaagaataaaaaaaagatttgctgacacttatatagcatatactatattcgattatgagtactataaatacagcaaataatttaattctcccagtcctgcaataacttatgtaggtaatatgtaggattcaaggtggcaaaaatagattatgtctaattttttaaaaaagcaatgctaagaactttgatccttgttttcctgaaaatgaagaattaatgaacatttgcaattcatccaaatcactagaaaatattttaaaataatatctatatgggatataaaaatagtaagaatcatattattcaagttaataaagtattatggtcttaattgatactttcaaaaatagtaaactacctaagatcagatcaatgatgaagtccattttggattttttacaaatctcataattgatcaagacagccttaatgttttcctaagcttgactaaactttagataagcttcttcctgcctctaggtctctgacctccctgtcatcccaacccttatagaatccagatggcctaatcacagaggtctctttcctctcttagagcctttactttagaaaacctgtaaattcaagctgggcgcagtggcttatgcctgtgatcccagcactttgggaggccgaggcgggcagatcacttgagatcaggagttcaagaccagcctgggcaacatggcaaaaccccatctttactataatacaaaacagttatcagggtatggtggcatgcgcctgtaatcccagctactcaggcggctgagtcaggagaatcgcttgaacccacatgatgaaggttgcagtgagctgagatggcaccactgcaccctagcctgggtgacagaatgagactgtctcaacaacaacaacaacaaaacgtgtaaatcctttctttgtccctttaagatgtaatttttttaaaaagcttcttgccaggtgtacaaagcaggaatgtctttaccaagaacctgggagatctcctttggaaaaactcagcagggctgggttgatactgctttctgatctcttttctctattgcagtagagttttttatttttttttaatttttgccctgtttaactttgcacagtccaatttttgctttgatataattacaatcctccaaactctgaggacagtagcattttgaagagtaaatatctggattcaacataatccccaaattccaaattctaacagtgtatataatgttcttaaataatagattgattactctcaatttagatttacttaagtaactaataagaagccatgtaagtacaaaataaactcaaaaaggacctatacattcgctacttacttctctaataactttatgtcttagtttcaaaaatgattctcaatttttcatttgtatggacttttttgatctaaatatcgcattcaaatatgacacatttctccaacaataacattagtatcagtatgcataagaaccctgcattaatagattttccttagatcctgtctacaattgaaaaaatatggcttaacaaaaatggatgatattctttgcatataatttttagaagaactcacatttcatatccaccaatattatacaatattaagagcttttccattatttttctctgaaggtagatagcacttaatggtatttgcaagaattatataattaaagaattacattgtgttaaagttggatactacccttctgaaaaaaaatctctaaaataaaacaaagataattctattttttgagttctcataagtaataccttcaaagccataatcttatcagtatttgttagtctaaggaattattttctattaaggaaaatatgaatataaaaagtcacaacttttgacacagttatctttcaatatgattcttatattgtcaatcatgttgtccaagctacaatatgtttagcaatttccaaaattcttaatattcttagcatcagcttttgggacacatgaaattcttttcatcttcatatttaatcaaactaaacaagcagatcaatctacatttctcaacatgattttaataaaagattctgtattttctattcatcaggggacagaagattcaaaggcaggcctagtcattaaagaggaagtggatgaagcaagagcatcaaagatctagcttggcacaaatgaaaagaaggtaatttttttcttcttcactgtaccatatgcttcctagagttctcagttctctattctacaattatccaaaaagaagatagaaagagttttaattattattctgtaaacaaaaacaaccccttaggtaaaagctttggaataccatttctatgctttaaaaatagaaattataattccctcactcaattgcctttcatttttgcctcttaataattatacagattatgtttccattattctctcaaagataagggctgcaaatttaggctgaactgtttcatttacctgtttcttgaaaccacttttgctctccaatttatctacctggccaattgatcaccatgacctatcaatttcagaacatgctttttgaatcgtggtctttttacacacagataaatacgcttaagatacatatagtagtttttttcaacggatattccataatcaagttgtggtgttaatcactactttaattataaataaagccatttaaaataagtggattcaccttggggcagtcactggcttgcaggtgcaatgttcagcaaatttttgtttcagacaataatgtctagaaatgaagtaaacaaaagtgtgcataacacattatttcactataaaaaaactgtgatatgagatgtaagcccttgccttgtttttcattgttgacagtttttatatcctgtgattggtatcatctgatattcactcataagctcagctttagtccagagtcagaaacactccagaccttggtcctcaatgatttcttgagttctaggtcaatggcttccaattagaaatcagtaaagttatctagaagcacttatgaaagagtttcaatatttaaaaatacctcatacacaatcatcacttacatttacctttaaggcttcattgatctgtagctaattaaagtgccaaacttttttgcatttaattggaattaatatcaactccatgaacttccatattacctcaggttttactcaagagtgacacatattattttggtttaggatgtttagttgattactttgtctctctcaggataatagtgttaaacctggctcatttatttgacagatagttgataacagatttcagatctttgctaggcactggggataaagaaataatagacttcaccttgctatcagtttgtttctaatctgattggagagggaggtaaaccaacaactatgatagacagtgataagtatattagcacagtgctaatcaaacatagaggatagacatctaactcagaacatgcagaaactgaaagtaacacatggtagtatatacctgtttgcttccatttgcctttcaaggaaaaatagcttcaaactgcttctgtgggtctttcccttttaactttgattttgacgagcaaaagcccttgttagcatataccatgcagtccaatatgcacatattggaatatatgcatattggactgcatggcatatcctaacaagggcttttgcctgttaaaaccaaagcttacagccaggcgaggtggctcacacctgtaatcctagcactctgggaggccgagatgggcggatcatgaggtcaagagatcaagaccatcctggctaacacagtgaaaccctgtctctactacaaatacaaaaaaaaaaaaaaaaaaaaaaaaaaaaaaattagccgggcgtggtggcggtcgcctgtagtcccagctactcgggaggctgaggcgggagaatggctggaaaccgagaggcggagcttgcagtgagctgagattgctccactgtgctgcgggctgggtgacagagggagactccctctcaaaacaaacaaacaaacaaacacaaccaataaacaaaataaaagcttacatagattacagctatttccaatctcaacactgtcttaagttggttgtctctgccaatgcttttcaagttctaaccatttcccttgctattagtacccttcctccagagaagctgatccatactggagttgtttttttgttgctggtttttgttgttttgttttttttttcctacatgactttgttctctctttgcagctgttggaaagtaagccctgctaatgtgatctctgccattttctttgtctaccaagatagaatcatttcagatattatcttttgcaccatgtttagtcctttaattttggagctgctggacagcttaggagttgatattccaggtgcctttttagagatttgatcttctcagaaaagaaaaatatcttatgctacctcctaacgtttctatcaaagacagacactaactgactttctaaattcaaagagtatagccctagaatcatcattactttatggctggtgtggagataagaaagacaaaggaaagaatacccatctcgtttgcatatccactaatccattcttttcaaatcagtataggtttttctctaaccaaatagcatcccgccaaattacctatgaagcaaccctactaacattctaatctactccacccaaaggcagagggtattacattgaacttcttataaaatatttttatcacaggttttggacgtagagaatatatatctttaaaatacattatcatttaaaataagtatagtaattttccatgaagaggaggaaaatataggaatgtcacaaaagtatgccagaacccaaatgtttttaaaaatggaggcagcagaaattttaataattgtttttgtttattgggttatattatcatcacgtaattgatacttcaatatccattcttattggagtcagttatatgaaagctttaaatagttacccaaaaagaaaaacaaaggtataaagaacactcatggccgggcgcggtggctcacgcctgtaatcccagcactttgggaggccgaggcgggcggatcacgaggtcaggagatcgagaccatcccggctaaaacggtgaaaccccgtctctactaaaaaaaaaaaaaaaaaattagccgggcgtagtggcggtcgcctgtagtcccagctacttgggaggctgaggcaggagaatggcgtgaacccgggaggcggagcttgcagtgagccgagatcccgcagctgcactccagcctgggcgacagagcgagactccgtctcaaaaaaaaaaaaaaaaaaaaaaaaaaaaaagaacactcattaactgttagtgagattattgtttttataaatggcagccaaagttacttccatgaacagtgtctttaaaagtaagctctaaattgtgtgttttgtagattcagcttgccatatttcccaatggaattcaggaagtgacgtttcctttaccaactcaatagctacactcctggaacattagctttgtctgctgagggataagagaatttatggctggaggatatggttctaatttacttgagatttcctgataactttgcttttctggcttttggcatcagtgatctaaattgacagatcaatttgggatagaaacatgcacttgtcaagttgtttccaaaagtgaatctgagacctaatgctgtttcccaagaactgctgctgctctttctattccaggccacccctactgagaatcactgtaatagattgatcggttcacagatacagagcaaaatgattgcacagggacaaagtcatggtggtaccatatggtaagtcaaggaaataaatacctctttaggcattgaataaaatagttttaaacctcatggtgaataaaaataatgtataatatcatatttattcactaatatatgtaatagctatttttttattctccacatttaaaaatagcaaccacaatcataattgtttatgtttaatggttccttaacaccaattatttaaaaaaaacagtatatcaatctgaaaatgcatcagcatgctagccatttttatataaaacttatattcaagaatatttacatattctatacacatattggactgcatagcatatgctaacaaagatgtttgcctgtcaaaaccgaagttaaaaggggatagacccatagtagaagtttgaaatcagtgtatggttatgtggacacagagaaagaaaatttctagagcaagttccaattttctgtatctttatgtgactgcctgaaatcaaatcccatcacacctttactttaaactgcttcctgcatctattgtatgcccataagacttattccccacaagggggtctgagtgatctttgtaaacatacaacaggtcttgttgcatcactctttaagttatcattgcattctttaaagtataccactcttctatggactcccaggctctatatcatcttttcttgagtccaattctgtgatattagctgggactacacttccaattacactctgcaatccaaatgctgtaaattgaatttctctgtgtttctgtacttctccaggcttgccctcatttctgtgtctttgtacgtcttgtatcctctgcatagaccccttttcttctggactatgtgggtcattctctgctcagatcaaagcatcagagatactttcccctagtgacaattaggtcacctatgctaatcagtctctatcccattacccaatttcattttcttcagaatatttgtcattatctgatttttacctatagactataaatacctcttgaaggttttatgagaatagagattttgtctgtctttgtctgattccatgtaggctactataacaaaatgccatagacagggtggcataacaataaatgttaatttctcacagttctggatgctgaaaagatcaaggtgctagcttatttgcttggtgagatccctcctcttggtttgcaggtggccagcctcttgctgtgtcctcacatggtagaaagagagatcctttctattctgcctcttcctatgagcacactaatttcattcttactaatttcaccatcattgcctgataacttcctaaagagcacacctccaaataccatcacattgaggattaagacttccacatataaattttagaagacaaaaatatttagtccatgtaagtcttattcacctctttattctcattgtccacagcaatacttgaaacataacaaacatacgcaatggacattcgttgaatgataaatgtaagtaactttcatttggtaccaatgatctgatactaaagttacattgcatcatatcagtttcttgtagattcaattttccaacttattctattttgagattctatttttctatgaccttcacagggtcttcttgacttatctctatttctcaatcctggaaaaaccccacactagattttgagttatggagtagtgattatttccataaggatgctgtaattaacaagaccctcttacaatgcttctggagcaagctagagtataaatatattttaaattaaaaccaatccatagacatatggagccacctcatcatctctttttccataggttgtacattttgtatatgtaagtttgtgtgacttaatttctagggtttaaaaaaaattaatttcttgcacatttccatggctgcgtccataatccaaagcaagaccctctaataacaaatggggtatctttgcaattttcatgttgttttaaagtgttaaattttatttggcttaaagctgcccccacacatagcaaactgcaacttaatttagtatgtaaaggaactgcaatctaaattaagagtatactcttttaataagtagcagaatttcagccaatgataatagccaagttttagccaatggcaggctgccaactgaccataccatgttcaaataaagccaatgatgagctgtaaccaatcaagctgtttctgcatatttcttcctttttttctgtctgcaaacactgcctgttcacgttgctgtggggagctctctgaactccttctagttctgacgtttttagcaactcatgacttgttctttcctcggataaactctgctaaatttaatttgtctagtgttttcttttaacagttttgtgtcaaaagtggggtccaaagtagtccactagtgactcccaggagcaccgagagatcaagcaaaggtacctgtcaggcccattatgctccttgttatcttgcagtaactggggtcaagggtgagttctccctcagatttgagctccacagatttgctttttgttcttcaaatttatttgagcaatttttactgaactgggatctcggattgaattggatcccataaataactggatcgaatccagaaagaggtctcagataccttaataaacatgagatttttaaatccaaggagtctgagactccaggagactaggactccattttctgggatactggctaactttatgtacaaaaattatgagcccagaattagtatatttttggagaaatgggttaaccttactaatgaaaacacagaattatggtaactagtgcggggaagttttaacttaaatgtgttggcttgtgaggtgaggtgccttagaaaagatagaatcagaaacaccaagaaagtaataggatgcattatttaattgttacacagagccatctaaaagattaaagaataaaagattaccacatcaaaagcttccctacagaaggcaaatgaagaaaatcttaagtttcttgacaaatattattcaaacgatgtagccatctgggcagaaactcttgttccattggccagtaaaacaatttggatctagaagttttttaagaaattagtgggttatgtagtattgtccttggcacataactaacattttttaattaaaatgataagagctatttaggtttatatatttatgtatgtcactatgtatgatgaatgtgtgtaatatttttctatctttttataatattgccaaattaaaatgtaaaagagctctatctaatcatcttcaaaataagtgcttatataaatcaggtattctgttagaaaaactaacctgaatacttttcaagtttacatgacttggctaatccttggtaaaaaaatattttgtgttgattaaatctggcatatcttcgaagttgtcagcattaaatatattgcagacatacaactatcttggtttactggtgaaataagctcatgttatctttgtattacaaattttttttcaggaagaaaaataacttaagatgatgactagctgctttgtctcgtctttataagcaatccaagctcaatagctaaatataagtaagttaaataactataagataaaattcctatgtgaaagatttcctccctatagcacaaggttttaacattcttatcaccaaaaattgaaaattatggctgagaaaaatctttacaagtaatttaattctcaagcctagcaaagaaaccaaaggacagtgatcaaaatgtttcccctctccagtttcttatttatttatttatttatttatttttgagacagggtctcactctgtcacctagactggagtgcagtggcacaatctcagctcactgcaacttcagcctcccaggctcaagcgagtctcctgcctcagcctcctgagtagttgggattacaggcacatgccactactgcccgggtaatttttgtattgttagtacagacgtggtttcaccatgttggccaggctggtcttgaactcctgacctcaaatgatccacccgcctcgacctcccaaagtgtcccctctacagtttcttatcacaaagagaggctaaagatgtctgtgactgtttgtaaacatgttttgtgccacattgataaattgtactatgagaaagcacatgcttctagacatcatgattcataaatttgccaatctacatattgctctgtgacagtttacaactgcttgcttcccactgttcactggaaatgaaggttactagagttaagaattttaatttatagatgttgcttaatttttaaaaaataatgagaaaacaactctatatgcaaatatgtaaggaaggtaaaatgtgcttttggtaagaaaaagctatcaagtatgaagagattttgttttagttaacgaaaaagaaagtatttttagtcccaaagaagaatgactattgtttcaaaataaaaaataatacagataaaataattgaagtgatataagaaggttgtagaagtttggtgggagaagaatcttgtgaaaggaatttaaaatgtaatcaagctggctaagattataagcagattatctataaattttttctaaaatttagtattaatatcaaaattatacagtcaaaactagaatgtgacctctctgctaaaacgagaactttttttttggagcattagtcggctttttacaggaaattgtaaaaggttttctttaccttttaggtcattggaaaaaaaaagattttgcattttaccgagataactttctatgctttgtattattagtttctgcatcactcaagaaagttaaatcctaatagaagagctaaggtttttccactaccatgtaactttctgtatttcctttgaagtctttatcactctggttaaatgatttactattttttcacagtgacctgtaatactattttgatgaacccttgatatttttgacaaacttcccaaaatcaaattctaaaatattttttattgttgtcaaattaactttgagattttccaaatgggtccttgagacacctcaaaaggctctctctccttagataaagatgagtattaaactaattgagcttatttgatatattaaattataagaaaaacactgtgaaataataagtaatgctaaaccttttttgagttctatttgtatggagtgttattattatgtgtttgagaaattgtatgatattcgtagaaatcttatcataccatttaactgagtaagaattcccagaactctaataaaacaactgaatgttttcatgctaacccaatttcaagcagaacaagaattatttgattactatggaactgctgtggcaggttttcattctaaggcagactaggctgaaattgttaagatgtacaattgaaatgaactctataagactgatccaagtcaaaatgatctatgttaaactatttaataaacagtgctatacacttgaattagagaaacaaaactggtatttaaaagtatgtaaattcaggccaggcgtggtggcttatgcttgtaatctcagcattttgggaggccaagacaaatggatcacgaagtcaagagatcgagaccatcctggttaagatggtaaaaccccgtctctactaaaaaataaaaaaattagctgggcgtggtggcaggcacctgtagtcccagctactccggaggctgaggcaggagaatcacttgaacccaggaggtggaggttgcagtgagccgagattgcaccactgcactccagcctgatgacagagtgagactccatctcaaaaaaagaaaaaaagaaaaaagaaaaagtatgcaaattcagtgttgagtgtggactcatggagaaccttaatggctgcctaatccttcctgagtatttaaagattctattcttcaaagctctgcattatatgatgcatcataaaagagataaaataatatgttatgaaaaaatgatgaggtgactgttctaaatctaaaattgttcataacctatgtctgatttgttaaacccataatcctgagaagacaataaaaacgtcagatggtacatttcttgcacctgttggatcatttgaacacttacagaaacatttcattcagttgccaccttcaatgcatgttttctgtttgtatggaagatttctcttgcaggaaggccaatattataaatagtagctaaaaccttattagtatccccttatagggcattcctggaaaaatatccagtgatagaggtcatcatttcactggacaagttgtaaaacagtcagttaaagtattacaaacacaatggcatttggtgaagcaaactgaatcaattagatttctttggtcaaaggtattaccaattaatggaagtcagattcactcctgccggaaaacataaattgaccacttatgaaatagttactggaaggcctatccccctaatcataagaacttcatgtgacttatgctcttatgaactctgacatggctcaatattttgagactttaatccaatatgctaatgtatgtttttgcaagataaaataagcccttcatgtcctgccaactgatgacaatcagacctttcatgattgagaacccagagattgggtttttggaattagcaccagagaaagactgccctataatttaattaaaagggactgtagcaagttcttaccacctatacatcagagcctcaaggattggcttcacattgtcttaactgaagagaaccttaactccagaaccttgggactgtacactcattggggacctcaaggtataattaaccaaggatgtttctcctcagaagaagatgacatcctagatgtgggcagctttcccaagatcatggaacaggaattatctcctccaccatgaaatcattgtcccctttcctttttctcctgtgtgttttcacgtatacatggcaagataatatgacaattaagatttcatgatcaatagcttttggagagaacttaactgaatgttacatatggcatgttactaacagcaggtaaaacttataatgagagttttacagttaaattattccagaaatttaataagaagaaagataattcagtggtttgtaaatgaatttaccaccctaatcccttaattgtaagtagccttcaaccatgcaatgattcaacaatagagccttagacaaatatcactagtgcttccctactgtgattcctaatgcataaagcatcctaccatctgttttgcctctctagtatatgtttttatctatgtaggatttaacaaccaaccctatgtgtgggcaactccatgtctcaataagtggaaaataaggggctactgtggactaaatattctgacagtagcattatcactccataaccaattggaaactgaacattggtctacacctcttaacatgcagtatagaataaagaggaatttgccagcaggtaataaataactctgcttgtaggatgcttcttccctggcttagcataatgtaaatgaagttatgattagaaatccgtctcaaatattagctactatagctgactctactacaaaggctacagatgcccaacaaacctatttaaattctcttgctaaaattgttttaggtaacaggattgctttggactacctgttgactgaaccgggggaatgtgtgtgctagttaacacctcgtgctagacttggataaataaatctggtataggagaaactcagttgaacggaatcaacagagaagctacttggttaaaacaagtagcttcctcttctggctctttgttgttaaatttaattctgtttactcgtgggggcttctgttaaggagtatatttcagtctcttggtattttatccccctgataactatcgtaatagttttcctggtgtgccatatcctcttaagagtcttaaatacttgtatgtggctacctcttgtacatcaagtggcctcactctggttaaatgacacaaaaaaaggagataatataaagaatcattctttatgtcatcaattgtgaattccatactgaggactaaacaagctcattatagtgatggagagtagcatcatgcccaaggatttggtcaatctctcaaaactgagaggctgaccaaaagaagggaattgttaaattagttatgtcctaaagctgcctctgtacatagtgacctgcaatctaagttagtatatataaacaagcagcaacctgacttaagggtatattcttgtaacaagtagctgagtctcagccaatcatagcagccaagcttcagccaattacaggctgtcactgatcagaccatgtccatataaaacaaatacctagctgtaaccactcaagctgtttctgtatgtcacttcctttttctatctacaaatactacctgcccacattgccatgtgaagctgtctgaatctcttctggttctaagggctgcaggattcatgtcttgttctttgttcaaataaactctgctaaatttaatttgtctaaggctttgttttctttaacaacactatatacatgcacatatacaaacatacacacatataagaacagtatttatgatgaactatgttcattagagaattattcaggatcttaaataattgttgactgtagtggtgttgtgataatgtaaaatcagaaatagacattttcaaagaaactctgttctagtacatatcatacagacataatccacagtataaaaactgaaaatataagctcttgctctctctctgagaaagaaaagtatgaggtcaaaatgcacatttttctttcaaatcagaatcagctctaaataaaggaaagctacaatacagatcacaaagaattgaaagtgcatttaaaaatctggtatggtgctttaatgtgtctctttgtgcagataggaaaccaaatttacaggctttcgaactaaacaatgagctttagttaactgaaaatcaaattcaaacaaaggtctcaagaaagactaaatttaattatactctgcactccatcaaaagtgacagattttttctattatattttcctgacattgaacgaaataagaaaaaagtctcttattggcatattgttttactgaaaactctttctatccacctaaattatacctttatatttgcaaggaagtcaaagtttgaataacatgtttgagttaattatggaacaccataaaaaacgaatctcagctagctcaaagatgaactattcttaattttaatctctttagaaatgatcaaattcaaaatgaacgtttaagattttgaaactctattataatattattcctttttaacctcctagttgtttcttttctaaaatctatacatatcacagagagattttacttttgatctggctattttaacttgtactcttctttgtagagaaggttaatgtcaagattaaataagcaagagagagaagagaagcaagtcgattggcaggaattgtctgggagctggaagaagcttccggatgtgaggtaatggcaaaagaaagacacccacaactccacactcctgctataccattttacaaccctaactatgggagaactcctcgacttctgtgggcttcaaggctaacagagggagctgcctagagagtgcacagaggcattgttcgagagagggaaaacatatggagtcccacaggcatccgaaccctgagcaggtgcaccttgctactattctgagatccaagtccccaaaggaagccagtgctgctgtggctgggccaaaaagatagaggagaaactgggaacttccatgaacaaatcccagcattgctgccgagggttgttgaggaaccaagacatgaccaaactgcattcccacagctacctgccggtgctgctccagctgaaaggattgccatcctccctagtggcaagtccacaggcagctccattctgagcccagtttccaaaagtctatgtcctgccctggggctagtgcagatgctgccactgctacccaaggacaaaaaagggtaggggaggccaggcactttcacacttcaagagcaaattctaccacagctactgcaggctactgtgataccaaggcaccaagaaaccacatgacccacagctacctcgctagcctgcttccattgtgagtgccttaccctccctagaggcaggcccgcggtgtacccacacctgattactcacccagcagcctgagaaccaccctgcccctgcctaagatagccagtccctgaattcactactgggggcctgaggacaagactgtggcctagtcctgttcactttgtaatgatgttttcaccatccaggggcctagaagttgtccagcccattctagccctgttggtgcctgaacactccttctaacactccttctaaggtctgaggtccggcaaacccaacttgcccagactaccatagcttgcactgatctgcacacaacaccagtgaaatggggccttggcctacccaccctgttgcagtcactactatcactagcactaccacttgtgttccagtgagttgctccaccactaccacagccattgaccacatcacaccagatgcccagggtgctgagaatctgcccaaaacctggccaacaactgccactactaccagcatttaagcaagacaactggaggtccaagaattggcccgtgtgtacctactaacactatggccaacaaagccacccactaacactacggatcccaagacaggtacgctcatcccacctctgccaccaggggggtctgaagactgcccatctggcatcccaacagattataagtcgaaaactgaaaaaaagacaaagaaggtcactatatataatgataaagagatcaatcagtcaaagggatatatcaattctaaatacactggagtacccagatttataaagcaaatattactagatctaaataaaaagatagactccataaaataacagtaggggacttcaacaccccactgcctgctttagatagatcatctaggcaggaaaatcaatgaaaaaaaagggatttaaactaggctctagaccaaatggatgtaattgacatttagaaaacattctatcccaaaactgcagaatatacagtcattaatcagcacgtgtagcattattcagagtaaaccatatgttacaccataaaacaagtctaaataaacttaaagaaatcaaaattaagtcaaataccttctcagaccacagtggagtaaaactgaaatcaacaacaggaaatactttggaaagtatacaaatatgtggaaactaagcatcatgctcttgaacaatcactgggttaataaagaaattaagcagaaaatttaaaaatgcttgaaaccgatgatacataccaaaacctgtgggatacaacaaaggcagtgttaagaggaaagtgtatagcaatatattcctacatcaaaaatgtagaaatatatcaaataacaatctaactttgtacattaaggaactcacaaagcaggaacaaagtaagctcaaaactagcagaaggaaggaaatagtaaagatcagagcataaagaaaccaaaatagagaattaaaaaataatacaaaagatcataaaaatgaaaagttgtttcttcaaaaagataaaattgataaattactagctagactaaccaagaaaggaagatccaaaagaaaataaaatcagaaatgaaaaaaagagattttataactgacaaaaagagattttataactgataaaagatcatcagagagtattaggaacaactgttatatgctaacaaactggaaaacctagagaaaatgggtaaattattaaaaacatacaactttcaagattgaatcaggaagtgatggaaaacctgaacagattcacagcaagcatggaaatttaatcagtaataaaaaagtctccaaacaaagaaaagcccaggactggatgaattcacagtgaaattagacgagtcaaacaaagagaaactaatatcaatcttcctgaaactatttcaaaaaattgaaagagaaggaattcttccctactcgttctatgaggccaacatcaccccaatactaaccattagacaaggacataacacaaaaagaaaactgcaggatgatatccctgatgaacatagatgcaaaactcctccacaaaacattaccacaccaaatccatcagcacatgaaaaagacaatgcaccatgataaagtgtgatatatttcacagatacaagggtggttcaacatgaaaaccaatcgatgtgatacagcacatcgatagattgaaggacaaaaattatataattatctcagtagatgcagaaaaatcatttgataaaatttaatatctttttatgataaaactcctcaacaaactaggcattgaaggaacatacctctaaataataaaggccaaatatgacacacccacagctaacatcgtattgaatggggaaaagttgaaagcatttcctctgaaaattagaacaagacaaggatgctattttcagcacttgtattaaacatagtagtggaagtcctagccaaagcaatcaggcaagacaaagaaataaaaagcatccaaattggaaaagaagaagtcaattgtatctcttcactgggaggaagcaaaaaacaaggcgcttgcatgtaataacagatctatataattttataatatgcaatattttacccatagctactggacatgtcatatcaacatgaaaaaaaaaaacatgtgcagttgctgatataaagaaaagaagtatatgcgctataatataataagtgataggacagtggtgattttggggtttgcacagggaagccttcttggaatttaaattgaggtaggaagaatgattaaaagttacatagctcccctatcagaaccatagaatttgcaaagtcttaaaatgtgaggtatatttaaaaagtatgaaaaaatcaatatggctggaatacagtgtatgaaattgagtacctgggaatctgtatttactggtaagaaaatctgtgtcaactcatttctcatttcccttccttcttaacacctagaaataaccccccactggtaaaacttatatcttcatcttcttaaacttccaacatttcccctctctactctctgtcttatctgatacttttgttctttgttttactgagaaaataggataaattagataaggactttcagattactgccctcaccgcaacccaaatgatgaaatctactaacctacattcatagtcagctatatattttgtcatgaagtagaggaatcatgttcctaaaaccagttctcctactttatgatctgatttcatctgcttatacacactcccagacacctcttttacagttggactcctcctttcttttcagcgttgtcaaaagtttttaaattctctcctctctactataatgtccatatcagaatatagtattatataatgtttctcgaaaaagaacttctttggaccctgcaacccactcctactagtgctctctttctgtgctcctctttatagtaacaaatgcacactcctctaacttgtagtttatatttatcacttcactttgtctttatccactctttaaactcctttcagtgaactttaaacttcattgcaaattttcctgtcaaagccattacttgcatccaggctgacatatccaggggtctttaaaaattttttccagactttatctaaatcatctcctcagcttttgacacatttcatcactacatgctttctgttttctttacttggcatcaaagatgtcatttttttttcttctttctcaataaatgctagttttagtctactttttttacttttcctcatttttaaaacttccaaataatgcagtggcccagcatcgaatcctaaattagaatcactgtctacatactacatgtagaattcaagcactttccattagctctgttgctaaggtcccagttaagccaccatcatctctcatctgacttactatttctctctgtattggtttcactacatatccaatggcctccttcagttcagcacttcaaagcatttgttctctgtgcctaaaatattcttacctgggtgtttggatgtcacttctttcaaaagccaccctgttagagatatcttcatttaacatacttcagcacacgtataaaacacattttcatatttaggttcttgctaaatatagttattctcataatatattgccctaattgcctttacttaacattacatcattagtatctgtcatgagtccacatttgaatgtaatttcaaaattttaatatttccataaatgtatttgagaggatacagtgcaaaaatagaagtatctgataccaaggattctctatcctgatgtagaaacatcattttgtgtctatgatggcagaagagaagaatataataaatattttgacaccagtatttcctaatggaattaaatgatgtagtagtacagctagaaatataaaccagattctttccccattttaatatcaggctagagtttcctgttccaagtttctgaatcatggctttttaatattcctcatgtacctcttttttcaagtataatagcatattgtttcattatatcttgcttatgacctccttgtatagcttattcacttcaatatttattgaactacattatgcatcaagtaccatatcagatgtcaggggtacaaaggatacataagacattgttgctgctctgagccacatggctacagttttacttggaaactacatgtccacattcatcacttctatctattggcttttctgtagaccaaaaaaagaaaataaaagagagagagagtaaaaattaatatctaatagaaagagaggataaaaccaaagggaatcagtattcctcagggaagattagcagtctaaaattttacctgagtgcacctctattttatctatagataattttaattcaatatgccttatatctatatatttgataaataaatctaaaatgcacacaataaatatttttgtagcaatatttatctaagccagtggaataaatatatttggtttgaaataagaaaacacccttcaaacacaaagagagtttgtgcagctttcaatgaatcaggggaacctcttttggggagaagcaggaatcaagagaattctcacatttacagaatttttctgcactctaatagaatgaacactgtattagtcccccagtattttctatggaagagaaataaggatttgcatttgtgaaaaaaaaaatttcttatgctgataaatcctgttttctctttatgtatgtaagactctaatttaaaactaaaagaaaaaacatttagtcagcaaggaacagttagatgtatgtcattacagtacttagatattaactacagctaggagaattaattcttgttaagatcagcaaagtgaaactaaacaaatacagcctgtcaactgactaactcttcagggaacaaatatctactagctggtaaatgttatctgggattatcaaagccattgtcaagaaaatgtgaacttgtggcttcttatgtctggagggatcatgaaatgtgtgcagatttggaaagagaaaataattagtttgatgctttttctaagatttggcttcagatactataactattataaggtataaattaatgatcaatctgaatattaatgatcataaggaagttcaaataaattagaagacaaataaataacaaagttaaaataattaataattaattttactatagctgttctctctcaatgatataggtaattgcattcacaaaaatacagcaatctaagtaaatttagaaatgcttaatgtcttaaaacattgaattgcaagaataatgcttaaatatattattaatacaataaatagcatatttcaatccaatgtcttttctttgttctcatgaaaaaatgttcagttacagaaatcagaaactgtagttgtgtgtctactatattgggagaatatagaaagtataagatatttatgtggacaaaggcatgtgatccaaaattatgctaaaattcaaattggaaattggagacaaagaatgaagaatattgtgtgtgcatgtgtatattgttgttctaattcttagtttacattggttatatttcaacttaatattcattcagtataagccatgccctgtgttaagttctatacataatagagtaatgattacaacatagtttcttggccataagtagcttacaatctagtaatggtataaggaagtacataattatatacatgtgaaaaacaagatgagcatcttaaaatggaataaacttctgtcagggacagttaggaaaagcttcatggtgaatgtgatgacgaagaacttggattatatggtaggaaacattatattacttatataagcttatatataactttcagcaaagcacagtgttaaaaaacacaatatggatatgtagatgtcctttcagtatgagcaacatgaaataatgtctttattgcagggaggagaaaatgcttctgttcttccaccaccctcaaattctgctgaccttgcaaattcccatggaaagagacaatgtcaatctaactaatcagaatctgaaatactgcgattgctccccagtagaatgcaaggtacacaaaaggcaaggattcagttggctttatgtatgtgtctacatcctatgatagtgtctagtatataataggtactttacaaatgtgtgctgaatgaataaaaaagcactaaaaatggtggttatcacttgttacaaagtagttgttttcctctatcagaatgtgtgttttttgaagataggaactacctctcactaactattagaaacacatagttattctgggcactgtttaatgttttagaatgaatggatgccagaaaaaatattaatgaacagccctacactctatatgaaaagggaaaatgtcttggcatttcagataacatcaatataagtgaacaagctatcaaccatttaaaggaagtcaaataggttttgaccttttcaattacatccatcctttaactcaaaggcattattagcacttaaattacagtgtttgtgtaaacaaatttcagttcaactagtcatcttccggaggaaacaaaatgtgtccagtgtaagttgatctaattatgaagtagaaaatcagaatttgtcacaaaggagaaggtgatgatgccaacatatcgtttgccagtctgatcaggaaaaggaacacaaaacacagaaataaattgcactttcatatgtttatatgggaaaggaaaaactccaaagagaaaatctctgagcaacacaaaaggaatttcacctctgccacttgcagggtaaaacaaaacattttgaataatgtgtttccccagatttgtagcaaggatgactctggaaatttgacctttaacagatgactacttcaaacactccctttttttttttttacttttttcctaatttacgtgccaaacgggaaaagtaatttccattatattatgaacagttcatcccctccctcactgcattttctcagggtcaacacaatcatcagcagtaatggatgcctactatagttgaggtggtagaaaagccgagtcaaattgaaataaaaccctgacgaaaaatttatgcctcgagttttaatatcatcgatggtctggtaatcagacataatgtgttagaaatctgtggagattataaatcagatttttctgactaatagaaactttctaaaacattccctttagcaaattattttcttaagaagtggcagagatgatattttgcacatatttgaaaagagaacttttctggagcaaagcaatttttaagctaaaagagataacttatccttaggcaagatccattaaaattattttgattctttttatgaattctcaatatacttggggtagagcaaaacccctacttattatatttgtgtacctaaccagtgggttaccttctgcctttctaatcatctgcctatctaactacccacgtaacataaacaaaggattggcttattgtaaggcagagggtttaattaatcaaataatctaattctggaaatcaagtatgtacaacaatcatcacaatctaaatgttaataaataatgtctttatattactaagtagaactgaggaacctcagaacctatgtatttgaattcctctgaacatataagtgatatacagggtatttattcctctttcatttaaaattatcttagatgtacccagttaatatagagtatagaattctaacattcattttggtaatataataatagtatgatgcatttgtatagaaatttattgttgacaatgaatatgctcataattatattatttaataccaagtaacagccttctaacaaagacaaatgtcattagacattataaaatcaaagcttaaaggggtgaagtgtggctcatgcttgtaattccagcactttgggaggccaaggcggggtgatcacttgaggtcaggagtttgagatcagcctggccaaaatggcaaaaccccatttctactaaagatacaaaaaaaattatctgggcatggtggcaagcgcctggaatcccagctactcagaaggctgaggcaagaaaatcacttgaacccgggaggccgagtgagccgaggtagcgccaccgtactccagcctgggcgacagagcgagactctcttccaaaaaagaaaaaaaaaaggaggggggcgggttggggggttaagtaacttactaaagatttccagtttcagcaagatggtcccattttgattatttatgtgtatggaaaaattttaaagttaaaaatccaacacttatttaacaaataaatattagcttgttatctattcttactttggtgattggctaagataacattcacaaaagagttcaagaaattttttttctcaaatacattgacataaaatatattaccaactacttcaaatgtggtcagatttggaaggaaaaacagtgtaacagagtacttgagaacgcaagatctgatgccagtgtgttttggtttaaaccctaacttggtcattcactctctgtccttagactatttattctctctcaccttcagtaatttttcagataaatatggggaaaatgaacctaactcggagggttatgctgtggttgaatgaaataaaacatgaacagattgagaagggagccgaatacaagtgtcccacctacacattgcctatttgtttattaatgcatcaacaaggaatgccaaataaagagttgccctcagccactctggtattgaatcaatgagtatgtgtgtacatgttaatgtgtgtgtcaaggagaaaaacaaataattggcagctggataagaggagaaaataaatttcacaagtttgaaggtgaggatttgactgggaatgtcaccacttgctaacacagaacacctatatctggagtctgtgaaatgctctttgatgttacgtggagagaaaaacactccctgatcccatacagcagtcagtaaatggcatttcctataacattataggtaaaattttaataatttgtagaatcaacagctgtaatttgccagcagtggtgaaaagattcaatgaggcaggtaatcgctgaggcagtctctaggttattctgttttagatttttttaacttagatttattctgttgtatcatatgtagtgttacgaattttgcatgactactgcccttgtggtgcaatgtgaattaaatgggttttagaaaggaaagtggtattttgcaggaaacagttttcttcataagcagcttatatgcaagtctgttttcaaagaggtaaattcatatgatgaagtattggtgcttactcagtaagcaactaggaatttggaagcaagccaaggggccagtacttaacacatttaaatcaaaaccaatattataggctagcagacactttgatgctaatgacacattacattattcttcagatctttattacaaggactccgaaggtgcagcctttgataggtgacagccttgctgggtttcaaggagtagaaactttgattcctctgagttactaggtttcacagttgtagcaggttggacttgatattttgttggtgaattccaggacaatttctttctgctacaactacaaagtggggtgaattaagcatgcttgttaatagcaaagcagaggaacacaatttcacttatggttttttttcttttgaatttgattaggaattccctttctaaataggtatgatatgagcatttaaaaaatttcataatttaaagaaaaactcatgaaaataactattttttgagctgaattatcctctatgtttccttgtgaaataaaattgcagtaagtatatgtatacattcattttacagcatttcttcttatcaaaatcagttaaagacagctcagctctgtttgttttattctattatgacttgaaaagtttgtgatttattttctattatatacaagcttataatatgtattatgtaatggattaattaaatgttcttatatagaactggatattttattctcaagtgatatttgatattaatttattttatgtttttcaaataatgtatgctatcatagtagcaatagtaataacaataaaaaggcatgaaaatgggccaggatgaacatttcttatttagtacacacagttcagattgaaaaagccatctggtttagttttttgtaaaaaacatgtatgtgtttccctaaagatgaattccagagaacatctgataataagatatttaaattgaattatttgaaatagtgatagaacattatcttagactaatgtagagccagcatttggggaaaaaattacaagtaaagaaaacaaaggatttgaattgatttttataaaatgataggtaactgaagattaatatactcagtcctttatgtcatgtggatatttattgaagaatgactgtatgcctaacattgcactttgtatgcacacttgagagaaactctccatcaagtatgaatctctgtgctgagtcagcatgctgctgtggtttgagtatcattctaaatgcaaaataggtaccaatctgtgtctggtaaacagtgtatgcaagcataagtcctggtttgcactgacagttcttgggtacgtagtcagaaatcttgacaactcatacatcagtgcaaagctcttggccgacactggttgtcctctctacttaataacctctcttttttcccttcacattagttgcttgagttttgtctcccctaatttactctaattcattcctaaaacctttctaatttgtattcttctcacactaccccactgcaactgctattcccaaggtcaccaatgacctcctttttgctaaaaccaatcaacatttctcagtttttgtttttgtttttttcccacacatgaactggtacttcatctgacaccactgcctccttccatcttcctgaaataaatgtttaaattcttattacgtctcttttagtgttttgtctccttacttgggctctcttgcttcattctgtctcttcttaaatgttgatatttttaaaagacctgtgcttagccttttatttttttcttttacttataaaacaaacaaaacctctcttattccattgctgggttagttcatacatcttcataggtttatttatatttgtatggctcccagggcagctttttcccatgaactccgggtctatagattcggcagcataatgaatattcttttgactccacttgctcagattcatctactcttcttcttccccatgctatcacctctgtttaggtcacatcatctctttcctcaatgaattttaacatacacttcactgatatatctgttttaagattatctagcttcagtccatcaataatcaaaagggattttttataaaatataaatgtattcatgtcactattctaataaagctaaaactctccagtgacttcctccttcaaacagattacaacataaactacatactaaggcgttacaagatttattttgtaatagttcctctccttccctccacccccttgtttcagcctctgtcacttaactcaatgctattgtcatactgacttttttcaggttgatatggaatataaattgttctctctatctctgagtgtttgtatatgctgtctgaaatgccatatcattgtacttggctaattctgttcattgttttagatctattctcagaaagtactcttcttggagtattttctccacacactgaagactagtttaagcacctttcctgtgaatctcataatacctagctcctgagtagatacttgcttccttcattaaagcgtgattctggaaggccagtactgagtcttacttattgttattgtccttagagtttagcatagtgattggaataaagttggtgttaaataaatatctatggtgtgatttcaaaaccactactaccaactactccaaaaacctaagaagcaagtctacataacagaaggtcagcatattttaagatatactcttggattaacatagcattatgtcacagctgtatacaaaaatctgtatttttttctttgcagcagactgaaaggtctaatttatggccatttaaaatgtgagcacagatatcctactgacatcacagaaatacatggttcatgtgtcactgaaagtacatatgttttcaatgaaagtacaagaaaataaggaaaggtacagtctaatataacaatttaaaggtagagcgttttcagggttggttgatgtagcgtctgtacaaaactatcagaggcctggattcttttcagcactcagccctcccatactaattatcttggttctctggctacttacagttggtaagatatttgtagcagctccgcaaaagatattgcatttctgtgtctttattttaggaaaaagaattttcatcatttccacccttatcccagcaggtttctgcctatacattataagcaaaaatcaggtctcagttttatttctagcaaggaagatgggcttataactattgtcctaaattaataaagggagaagtataaatggatgacaagaagttaaacatcattgctaatacaaaaccaagtgccaaaaagttgccactatttagggtctgaatccaatgccaacacatagaatgcttctttattaagcccatatgtgaatatcatggatggaaacagtgaacaggtagttcttacatggtcagttaaaatagtataattgcaagcagatatagttactaaataattaaaggaccatctcaagttcaactagaaaaaacacaaaagttgattctagaggtaacagaaataatttaatatgagcaaaatattctgcagccatgagactaaaaagcagagttatctaatgtgattatcttggtaaacaggtcctaaagatgatttcaaaaaacattagccaaatttgtatacctggtaaaggctttatcttgaacaagaaaaatgtatcgtatgtcccgttagctcagcctttaatatatgatatataaatatatgttaatatttatatatatatatgtgtattccatctctaattacatatatttagtgaggaaaggtgggggagagagagagaagcaagaatgtggatatacagtttaatataaacataataaggatatagaaaacacacacacaccacacatacacacaaacacacacatacaaatgaacaaaatggcaatctatctacttaataaaacagtgtgaataaaagttccggatatagataacctacttataagttgtttcctagctctattattcactagcagtgtgactttcctaaataatcctacgttttcttatcaataaaattgtgatagtttgcaatttaggattgttgggcaattaaaggggaaaatgtgtaagtgttcaacacagtaccgagcatgctttaaacatcacttgaatattagctataataaaataaaaattattatttacaatattagacatacaatacagccataataaaattataagcaagatcttattcataaaactttttaaaattgtctattaaaatcttttatttaatcaggctcaaagagcagaccaaaaccattgcttctataggttcaatttctttcctttattcatatctctatggaaattaagcagagagataatgtcatacagatgaatattaggagataaatttgtgttgctgtaagttctttgaagctcacagtctacttgcaataaagttttctgaaaatgtgaatcacagatacgacattagggacgatagaaaacaagagaccaacaagaaaacatgaaaaagtgacacagtgtaattaactgtaacagttaattcatagataattttatcttgcgatcttgaaggaaaataataactaaagtctacccaaattttcttcgttcataatctgtggtcttggcctcttgcacaaataagcataaaatatccacactggggttgtagagtcatttgaaatacatggcattatttttgaaaaatttggatagactttagttatcatttactgtgaagtcaatacatagccatcaataagtataataagtgagtttgtttagtcatttccctttactttttgataacctgtgtgaacctaaaataaaattaggaagtcaaaaaaaatgcattagtggcttttgttctccagtggagtcactattaaggggtatgtaaatccttcatgttagagtagacaaagctcatcttctgtcagtacattgcatagtcaagtaatacaaaagactgaacacgtggaagatgctttgagctctttgcaaagaataatccatgataaaaataatttacttgtcttgcatgttaccatattttattttaatcattttcataattttcttatactatctgatgttttctaatacaatcatcaagtttacaaaatcataaaaaaatcattacagtacaaatgtaggcacatgcattatcagtcataaggtttatttgaattcagcttacatggtttcagggttagcagttacaaagctgttagctgaaggggaagctctaatgtactggaaaacttggacaacacagatatagcttcatagtagatctaaatttgtattgtatgccatcttcaaattgttgagcctttttactcaataatcaatatttcatccagcacaataataaaatatagaattatttatggttataattaagatgtactttttcagtcacaagagaatgaaaaagttactggagaggtgatgtgatttaatgaaaaggccattgaataagcagctaaggctctcaaatgagacaatgaatgtgaaagcctttgaagaaagataaagtattatgcaaactcatagtattaatattaaaagcctaaagtgttcatttctagtagacctcatgggttttttggctgtctatcagaatcacattaaaaagtattctataaaaacagtaatatttggtaccatatgaaaatctaagactcatgttttaacatcaaacttggaattttctccttttatgatattaaagggtgacccttaagatccgttctgcaaaaaatattttaactttttttttatagtggcattcggcgagtgttcttgtcttttacttttaggaaatgtgtaatagcaactgcattattaaaactaggtatattccaaaaaggttgtcagagaccatgacacacttggattcaatctcagtggagtaactgcaagtaattgtcccaaagtcatcacttttggatgtctcaatgaatctggctttgataacatgaaaatttttatttaggaaagctcgtggaggaaggaacatgactacttttgctgtaaaatgccaaattacacagaaatttaatttaaggtttaaattaaatttaagaaagccttaaattaatttaagaagccacagccatctctctctctctctctgtctacttcagctgacgcataaatgtgtttcaaagaagcatgctttacaattaaaattaatatcaattaaaattaatatgtattcatttcatatcctttcagatatcttttccaagtgaagttcaaaaatcttcataaaacaatcccattaatccttggagcattcttatgtggaaagtaggaagagaaatgttattcatccttttataaagtttgaaaaataaagtataaaggattttaggtaagctataacaattaagtcagtgggagatccagacatacaacaaaggttttataattctttttcttttactttactctaataatggcatttttaatgcttttacttttctttattgattaaaagatcttatccctctcttctcagtggaacatgtgctcctggaagaaaggagacataaaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacacgtaccctaaaacttagagtataataaaaaaaaaaaataaaaaataaaataaaataaaataaaattatatctctaatgcctattctaatgtgcagaaagcaattaataaatatatttgaaattgaattaaatcaaatgtgctttgtttttcatttcaaaagcacacacacacacatacacacacatatatatgatatatatcatatatatatatgtgtattttgtttttattcaaacatcgcaaaagagttacacagtgaaaagcaggtatctctcctctctagatatatatgccctgatccagaggcaaatgtctatcacttttttatatccaatctatctttctatataatttaatgtaaattaatgaacatgtgtgtctttgtgtttctatttatttttgaacaactgggagcaaaatgaatatactgttctacatttgtgggtttttaacaacaatatttattggataacttttaaaataaactcttcatttggaaataattttaaatttaccacaaagtagcaaaaattaaaaaaaatgaggaacattcatctacttttaaccaaaattcagattctgctcttatgaatattttatgttattgtttaatcatttgtttaatccttttatttgtccctccagcccctcccctgactctctttccaaaatcatttgagggaagttgcatacatcatggtcttttactcctaaatatttgtatttttattgcctagaataactctttcatcttatattaccacattaaaattatcaacatatttaatattgatatgataattttaaataatacatggctgcatatcaacgttgcctgttgaaatgtttgccttttcaccccttcagtatgggaccaagtctagaattaggtgttgcatttagttatttcttttgagctttttttaacctgaattatatcagagcctttctttgtctttaatgtcatggataattttgaagaatacaatctccccactctcacagaatattcctcaccttcagtttgtctgacgttcatgattagttttaaattatgcattccaggcaaaaaaataatacacaggtgattttgttatctgggaaacaaatctgggggtacataatatccatctgtccctcactgataatgttaatttaaaaaatgcaattaactattttctggttttccacagtaatgattatttttgttcttccttgaaactaataggaagtccttggaaagtcactttatgactatacatgtatcatgccccacaataaaattagtccctggatttagcatccattggtgattcttttctcatcccatctttactactacggaagcaaaacgacaattttccaagtatctctccctctaacatttccaactggctgtctgaattctaatgtaaaaaaggatcatctcttttcccctaattactaactctttattattattacgggctcataaattttattttgtttcatagcttataatttgatacctcattattttgtttgatagcttgtaattcattactgctccaaattgtttgggttctgacatttttgtagattgggtcatgacaccattcttgaaagtctagaaggagcagagtggtctcgcctaagaggaaaaagatcgcttagatcagtagagagtgtattagcagcagttgattgcaggctggcctcagatactagacctgtttgactgctttatgtgggaaagcactttataaagtgcctcctaaaatgcaatgtaacttcttccaaccttcacttcaggtggttaaccatgtgtcaaaaggcctggtctgacaatgctgacaagcctttagcttcatactcactacctgtctgacttggcccaataagccactcttcctgagccttgcctgagcctgctttgccaatccagctctcaaatcatctgagactaggggagggggggaaattgagaaaataccactgtatttacctttggtggcctcccagtgtctcagaagttatccacactctactggcaacctccatcttttcactatacaatcacactgcccagttgcctccctttgctggggaccttcacatggctgaggttctaggaaaatatttaagggctttggagtgagatttaaattctgcctagggcctcaacctcaagtagaacaagttcccttttatgcagttaacaggcagacattgattatagagctgcacccattcagtctaactccagagaacgcgttacaaaaaatctccatttgcaggatcctgcaatgcaaaggtgtgtaagacattccccttcagctcactcgccacgaagctggatttggtaaacatagatactgcctcaggttcaatctatctttcccttgaatctgcatcatttcatttatttaaatgacctctcagattcctttattttgatactttgtccatgtgaataggcacggacccttaaacaagtatcttttttgctatttcttctattgaatatttcacatgtaatgactcctttttaaatcctgtactttctgtttatcaggacacattgactttggactaaagtttcaagagcctttaccgattttatgattttatttgattgtccggggaagtactttagagtagaaaaaatagggtctttaaaggcaaatagaaagaataaaagagagggaaaaatggaggaagggggtggctgaaaacctagctgtcccatccaaccttacctttatacaatggcatgcataaggcaccaatcccccactccccaccacatatatatacacacacatgtacacatacaacacacacctcccagctccctatgggctctaatggctcttcagaactttcagcgatgcaagttaagggaactgactctagctactaacagagcccaggaacaagacaccttttagatattttgcttttttaagcagattaacattaaggtggccccaagtgataaaatctgcaatgtgactcttgactttcctcttcttcaataatgggttgaaaataggggtttctaacccaacatgtactctttccaaattgtctaattagtggcaaacactgcagccatttctccaggtctccaaactcaaaatgagtacatgagggtacagtttctttttgagctcacagggtaggcatctggccatctcatctggctccaataatcaatttttcttggttactgacaaatttttctcaatcaaaattattcttgttgggtgagctctgctacttgcaaacttagggaaattaataaaatatatctaacaaatgatttggcagtggcagctgacagtcacttagaggtctctgagaatgttctgtgattgttccctgtggtagacacaccctgaggtgaccctcaatgattcacattcttgtcttattccctccccttgagtgtgggcagaacctgtgacttacagccaatagaataaggcaaaggtgatgggtcgctcccatgattttattagactatgtaagattccattttagcagacttaaacaagagattctcctgctggctttgaagaagtaagcttcacttttatgaaaagcccatgaaagagcctcctggcaaggaactaaggcggcctatagattctgagggtggtatcctactgatggccatcaggaaaacagggacttccatcctacagctgcaagaaacagaattctgccaaaaactacctgggtctgaaaacgaaccctgaactccagagagaaaaaaaggttagtagacacctctattgcagcctccagagacccatgaataaaagacctatccaagctgtgtccatatcactggcccaatgaaactgcaagataataaatgtctattgctttaagcatctaaatttgtggtaacttgttacacagcaatataaaacaaatacatttttcatgcagtgagaagagtccaggaggagaaaagactggccatattcagcctgcccctgtgacttctaaggctatgctgctgctggtggtgtttgtcatttttctcactaaggtaaaaaagtgaattaagatgaaagaaatgcaagagaaatgcttataaatactaagaacagcagcatcttgcctaggtcatgcctacgcctacacgcacataagcaacacacatcctgtactttctagaatgctttgcactgtttaatgatgctgggcggtcatttgctgactaccctccaggcatgtttttaccaattagattaggaaagatggtgactgccacagcagctcgagggctgtgtcagaaactctcaggatgtaagttgttttaccaacaccattggggcaggagacagacagggattagtgaaggggtgggtttcattgcctccttctaaaagtagctttatctctcacctcagaccttctagttctggctctaccactaagttctaatagagctccccaaattaaactctaatagagaaatcctttcagattatggctccctaaagggatctaagtctggggtctctcatcatacattcatttaatcagcatttaatgagcttctactctgcgctagcactgctgatacagcaatggatacaacttataaaatcccaaaacacataaagcctagaggctaatgggggacacagagaaggcaatggtcaatttaaatacattacagggaaagtgaaaatgctctatgagcacaaaagagggacacctcactcatcaaagaggttctaggaagaaaccccaaacaccaccagtaacgatgaaaaggaattgacatagcagagttcttcaaacagaaagaacatgtgccaatgcccagaggtgagtttcaggagcagcagaactgaagcatagggtttatgggtgagtaataataattataagggacagcatttatccagcatgtactgtgtcagtgcagtattaagtgggtggtatgcattatctcatttgatcctcacttcatcccactgatgaggcaactggggcacagagaagttaaattctctgctcatagtcacaacactggttaagtgggaagccaggaattaatgcctagccaactgactcctaagcccacactataatggcccactctaaactaaaaaaaatacaccaaatggtgagatcagccatctacccttcactaatagaaacaccaactcatcctatgggtagaaatccaccaaggttctacaactccctgatctcagacactccgtccagccctcgagttctcttgccaaaaacagagaggagcaattaggtctcctccagttactgggtcccaggttagcatgccaggtttctagattaaggttctgcccttctaggcttcctggaaactacaatcttgtctctgagttcagtcttcttgcctagattcctcctatcagacatcagacaccatgttctgcctccttttttgaacttcgttatattttggccccatgggcatcctcaaattgtttttgggtctctgtgcttctgtctggtttctagggtctagtcatcttcagtttagcccgaatacaagagatttctgagtgagtatctttgtcacatagaggtggctgtgatgtttcctaggcatagtattgtgcccaactgttccagtttcaaaaccccccttttgatctcaatttctctgaagccatggtgcatcccagtcctccttccatgttagctcctagggttagtactcaaatcctgttactttgtttttcaaactattttggaaagaggtagaatataattttcctcctctttagattattcaaaaatatcttgccctcttctacaacaagaacaaattaattaaagtgatttttttctaagtaaatcaaaaatttcttgagaataaatctataatcatcatagagctaccagaataaatagctcaatgtgtagccaaattttaaaacaaaagtttacaccattatacagttttacatatttaaattaaaataatttgtatatacatacacattaattgtacattcatatttatatattagagtgtagtagtattttccaatccaaccgatttttaagctgtgtctaaaatatacctttctctcttttggtttcagttaatttctccaatgtcttagagtttaagagctcttctatttagcaggccatgaatatctcctagtgtaccattgcttttttttttttttttttttttttgagacagagtctcgctcagttgccaaggctggagcgcagtggcttgatctccgctcactgcaagctccgcctcctgggttcacgccattctcctgcctcagcctccggagtagctgggactacaggcgcccgtcaaccattgcttcttagagtatcctgcaaccttctagagagtctaggtcttcattccagaaggtttctttgtttatttgcctacacactcatgaacagtttaccatctataaacatgcttataaatggctactgaaagagtcattttaaaagaataaattaactgctgagtaaatgactcccacaattttctatatttttggatatattgctatcttttgttctaactgtgcttgaaatttttaaacgtagctatatgttctataaacactttatttattataaatacgttttgtacaagttatgaaggccaatttacaaaggtaaatgttacttaataattcatatatctgcccaccaaatcaactttttccattcctgaaagggttattatttgacagttctgaccagcaagtctttattccttttctgttgtaaattgcttgaacatgacttcaactcctaagtatcaatttcctgctggactccttgctatctaatatctcaaactactttctttaaggccaccagtgaccttccctgcaatttaaagtgcaattttctttgttctatattttgagactttctgcaccctttcatatgatgggacatcacattctcaattacattctttctagttttagtagcatcagttataccctggtacaagttttgtacaaacacactcacatacacagtttctatgatgagtctgtatctcttcatatccttcaactatctgtgtgttacaaatgaccattaggatacaatattttttattattctgtgcataactcaaaatgcacaatctgttctcttacttaaatacttatataattagttatagggttacacacatattagtgggaaggaggctgcagatatgggcatgcattttatttatgctctaagaaagtccactcaaattttatttctatgattaacattcagtagcatctcagtactttgttgttcccaggtgtaaatacactttttgcaatcttctgtttactcacaccatttattcacttgaccatatatatctagctgatttccttactccagacactggaggttcagtgctgattcagagtagactctggccattactttcataaagattacagtctcgtgggaagactggcattaacaatttaatcaaccaagaaagcctacaatggaaacttttgaaagtgttaaatactgtgttaagaacctgtaatagggatatctggcctcatcaggaaggtcaaggaggaattccttaaggctgtgcttctttaactgagaattgaataataaatttgaagtaaacatgtggaaaaggttcagaggaacctgctagccagacagaatggcataaactaaggctcagtggtggaactgaagaagaaattgtaagagagatgaaaagaaagtaaatgttgctggaacacacagaccatcatgctgggccttatgaagcatactagttttgttattatcctgtacgtaatggaaggccactgaagagttttaggtcacaagggaatggaaggaagattatggggaagaggggaaaggagtgtcatgttcagatttgtatttcctgcatagaggtttcagaggattttctaccctcagcaccatcttttccttcctgatctgaagttttaatagtctagatgtagttatcctccttattcaaaggctctttgattctgagtctcctttgtttgttcttcctcctcttcaccacttttaaatagaggaatttcctaaggcttcttgataaccaatacctacatgtcttatttgctctttagtggacatctcaagcatagcatgtctaaagtacacaaagaaagaacctagtttctcttccttccttccttccttccttccttccttccttccttccttccttccttccttctctcaggcagccagacattcattcagcaaacttctgcagagcactttgctaggccataggtattcagaaaagaattagggagaatctttgacctcaagagagtaaaataccctctatgatttgtgactacaaccctgtctgtggatttttttttgttctttcccccaaatatttacctttctatatctccacctccctaatgcccctcagtttatcctattttctaccctcagaaccatgttctctttctcatgccaaagttatcacttgcacgctcttatgcaagaatgctctgagagttaatattaaagatacaggcaagtgagaagcggttcccttccaagtagataggcaattgtcttgcctcttctgtcatgccttttctgtcctattgcctgttgtgctctgctatgacacacattttcttgatacaccaccaccaccatccttatgtaacttcgccacctatcagaatgcctataacattgtagatgggagcggtcatacataaagcctaattctctttggataccatctaaatatatcggaatctcaccatgatgaaataagtgaataaacttagaataaatttctgggagacagcctaagagacagctgtgaaactagctagtgttatgctctgttcccatgctgagcacctctttccatcttcccccattatttatttgtgttcactgtaaatcacatgccacttgagaaaattttacaccaagaaaagaatgacacaatgcttattgttttcttttaaaataattatttaatatataacttttatataatgttgttcagataatttaaaaaataagtgcaatgaactgagttattctataagaaggggagttcctttccctggattttcccactgaccccagcccaatagtaaagcattttgtcattcagcatcatacacttcctatccctagttcatgtttgctcaagttcataaatagtgaataaatactgacttcagaaactctttcccaaactctggtattcctctcaattatgtcatgtgtgacccacctttctattcttgagtaattaatcaccccatccaacattatccattatttaaaataacttaatagattgatatacctagtaaagttagcggaaattaatgaagtagaatgtgttgaccattcctgttcctttgatgtgtcagactgctttaaatggtgccaaataatcctgcttcttacctcttttaggaagcattcctcattttctcaaaaccacagtgatccatctcatcacagcccttctagagtatttaaaatttgaataacctaatttaaacatccagccaaggattaaagttatgcagttatgacagttgtccttactggttatttacaattagaatctgttctgataccttggtgcaaatttttagctctccctcactcctgcctttgcttatgataagcaacttgaccttaactgaacacactgtgctttctcttctcattttgactttgttcttaatgaggtccctctatctgaaatatcctttgcccacctgtacctgaaaaagtctctaattttccaaaactcagctaagtgacagcttatttttaaagattttccagatttttacacatagaataaatcactccttgtgggtgtcccctgagcactctgtgcatatctctaatgtaaaacttatcacaatggattgtaattatttatttccaactttgtgttggtcactagaccatgaacccctggagagcagtggtggtgctctgttcactgctggcatgccataagtgctcagtagttgagtggctgagctttaaataatttgtagaatgagtcagagcacttaaaagtgaagggaaaataccttagtggaatgaatagatttttagaaaatgttttacacattcattaatgccttgattctacaagattataaacagtggggaagaataacctaatttaaacattacattttttatccttttctatttgtatctctcttgaggtagtattaagtacatgttagatgcttcattaaaacaaaacaaacaagcaacctacacacacacacactgagagagagagagagagagagagagagagagagagagagagatttttaaaataaaaacatactttgcctctaatgactatgttaagaatacagaacgtcatgagtaaagaagaactgaaaaactttaactcaattctatcaccacttcatcaccaatatgagacaatggactgttgaaaagcagagactgttggtctctacatatatcagacaaataaaactttcataactccaggtttgaaactctcattgacttatgaaaaatcatagaataaaaagtagcaaagtaaaacagagtaaaagataaaaggtaaagctataagactttctattttattacgtacttagatttgtatgtatatgatatcccatattatatcattttagatttgagaaaagttcctaaaagttatttaattcattttttatcttacaatagttaaaattaaaacatcagaagttttatatgcagtaaatgattaacccgtgtttaccaacaaaatctacaatcagcatctagtttcaaaagtaattagtatgattggttcccaaaattgtgtttgtactataccagagttttcatgttagtgaatagcaatttttaatgaaactcctgaatgaattaaaagacacagacacataatactaagcaagtcagtaacaatgaaaacaatgaaaatactaaagagaggcaatagtaattgaacatttactatatgcaaggcactgttctccatgcttataagattagttcatgaaattttcacaacaaacttacgaggtaggtacttttatttcccgttttttttttttttttttattatgaaggcatgaagactgaaaagggtggaacaacaaattgtattccggtagtctggtcccagacttttaaaaatattaaaagtcaacatttaaaacccaaatgtaacataaaaatctattttagattaaaacatacctgagaacttagagacacacagaagcacaagaaatgcaaatgaatgtatcctttaacttatgtttcctatttcccataaagtttttggttttaattagacacacctggtcccagactacctgaatacaatttgcacgcacttattgcatattcttacatgcaacaagtgcacgcaaacaaaaaagaaagtgtctttaaaagcatctgctcttttcttgctctgctgagaaaaagtgttttctagcatgatcatagcctcttctgtacttcaaatggagaaaagttgctggaacttaactttacaccttgcctctcatcacagcaaattgtgtcattttcttccccatattattggtttcactcagctccatattttatctgactgactgcagcacaaatatgtatactcagttttaggcaaaatgcattttccacattgacccaaatgttaggagatacccttgagagttttatggtgtgccatggcacacaggtagagagccacttacttgtgaaaatttacctagacaacctttatgatatgctcagttccatgccactgagaccagtatcaaacactgaacaacaaattctctgcttttagcagaatttagcattaaaaagtactgttgtccatttatattttctcatcaaaaacactattaaaattaattcatggatataagttgttaaaaatagctaaacccaaggcccagtacctttagtgctattaaacatctactgcttaatagctctagattattttttcattttatgcagttcgaatgtgaacaagcttctctgtctctaactctgaaagaagtggaaaagtcttcataatttattaacccctgaaaagggcacattcgtttgtcatagcttcagaggcagagagagaaagcagataaaaaatcacattcgtactttcaattattgaattctaattttactgtcttattctgcatacttcaaatgggcattactaaagggactaagttcagggctattgttttattattatgcaataggaccacagtaaaatattttgagccaaatcaagtgtgttcagttaacttttgttgtacaatttatatgtatgtcactagacagattcttcagtggctaattaaatgatactatctaaaaacaatttatcttcaactgataggttctacgtatggattggttttctctgaggaggttgtattttaggctttttatttcttttaaatcactgagtatctgtaaataagttgaatagcgaataaatatcactttttagtgccattgtcctaggaactagcattagtagctaccaagacagtgaaaaaattggccttaaaaagtaaattgtctctagtttgcttgttcaaacacaaactactatcatttgggagatattaagtttttaattaaaataaaaaaattcttcattttttattattttacttatactataaagaaccttgtccaaagtcaaacaactgtaaactcggcatactattaccagcaaataattgattgtaaaatagacaataaaaataaagctagcttgcttgaacatacattataaatacaagataactttgtccaaaaatgattgatactgttttgatatctaccacaagctattttattcttataatatttcagtgaccacattcagaatcaagtatgagttataaaataattgatagacttttcacaaaacccaaatataatgtaaaaatctattttagattaaaacatacctgagaacttagagacacacagaaacacaagaaatgcaaatgaatgtatcctttaacttatgtttcctatttcccataaagtttttggttttaattagccacaccttaaaatacattctacttttatagtaaattaaagatgagagcttttcaggtagaaaaaaaataatatgtgcaacaacaagaatttttttacattgttcagttataaatgccaagtacctagaagagtgcctggcacgaagtagatactcaagagaagtgactgattagataaccggctgtattaagggagggagggagagagaaagagaaagaaagaaagaaagagaaattgattgatttggggcactgaaatttgtaaacctgtttctgagtcctagctcctccatttactgacttactgactgggtgatctttggcaacaagttacgaattattagtctctgtttccttagttgcataatatcaattactttatcacatatcaattgttaagaattaattgtatatatacacaaggttgataaaaagatcttttaaactttaaaatgcataaaaacattacatttatgtacctaaaatatacacctaaatatccagacattcacacaataagtccaagctgtccaaaatgacatcatagttactatattttttggcttaagtaaaaagttggcctggaatgcccagaatttcccactgtcaagacaagcatagaattcatgatcattcaagtgcttgaactgagaaactaaaaaaccaagcagtattgtgcattcaatcattacatgaaactaataaaggggcttacaataaactaaattctaggaaagtgttaaaatatacaaaagagtattattttgcaataggtaaaaacataatttgaggagtcattttcaaaagaaaaaatatatcacccccagcatatggagtatgcagagaacttcagaagagttaataagtatcttttcatggctatttttttccatctcttcttaatactggttacataagtcagacaaagaacatatgtatttaaaaggaggcagagaatagggcagtacaagtaacatcacacatcatttatttatgtcaccctgtactgggaagccttcctagggactttgtggcataggaaattgctatgatatcattgatgtcctctcttaaattaaaaataataataaaaaactttttgtgaaatgaatgaagtccattagctaggtagctcatatctcgtgtacttgcgttgtataaagttgtccaaaggaaaagaaggagataagcaatttaacactgcagtcaccatcaatgtagtgcatttgtgactagcaaggctaatactgaaagaaggaatcatacacagaaaaaaatgcaatttaaatgtctagatcattcattagctgaataagattttcttcattgttgacagaatgatataaatagatttttaaagaattaattattaggagacaaatgcttttcccttagttaagtttaatcacctgtgaaaatgacacagtcagtaccactgggtttttcaacttcactatagagtacttagggaaagaaaaaaaattcatttcaaagcagtgactcatgctttcaagctcatattatccaaaacttttagatttcactttaaattttgaaattcacagaatataccaacttaaatttttctcagcaaaaaattgactctagatgtatattggaagctttttgaggttttgttgattacgtattgttgtggctgagacattaagctcacttgtttagatttaattaatacacgtctgacactgtctataaacttagttttgttcagacctgaatggactaaaggagacaattcgaacaacagtaatgtctagagctgccaaacaggactgggctagcagaagacacagagtgtgacatagctgaaaaacccctgctgtcttaaagctcaactcgagaatctccaaatcctgagttttaattatcaaaattactagtttgcaaaggcagaaatattctatgttaaaggcacagtaaaaataaatctaaaaagcataagcacatcaacacttgatgaacaagccattattcaaaagttttataaccctaggaggaatggagatgctattaaaataaaagagcacgttaaacaaaataacaattaattacacttttctgtggctttatttcataaataactgcatccaactttaaaataacaacagtatgctactttataccataataatagacaacatttgaggggatacaaatgtttttgaattcttcatttgttatcatgtgaacattctcagtcaattgaaagcttttagtgtagtgacttttcaggttctctgtcacattcaatcacctatccatagcagttcaacagctctaaatatatttgttttgctacaatataacaagatcctcaggcataaatgttactactgacaaatgattaaataatataaagatatatttttaggatttaaatattttctggctatgtaaagacagtattttattatgcaccaaaaagcataacaaaaatgcaataaatgattttaatatctcttaattccacaaagaaacccttacatccattcttaaaatttttcattattattatttccaaatatttaaatggtaaatatgaatgtaaagtcctacaactttatttcagaagccagagcctttgctcacttggtaaactttgttttccctgtataaatgcaactttggaaaactgtcccaaagaactgccatttaacaattagaaactttgactcattttaagtctacagcaacactacttggttgaccatttctaccactattctttaatactaatagaaaaatatagagaaatgatgcagaatgatatacatacacatatacagttttaaaaacacattcaaaattgtggtcttataatagcagtattttcctttttctaaagcgaagccggatttacctgcctttcattttctgctgcaaattagtttgtcaggtacacgttagcaagctctttttttaattcattttgctaactccatagtcctttaaataatgataaacattcctgaataaaagcttaccagatagtaatcctttttgacccttataatattttctctgtaagacacatctacctttattttaaaagagaaggtaaaacagaagaagcccttaccagagacagagaaaacaattcgttcagctagatccaacagtgctctgtgcagcctggaagcatgagtgatccttgggcctcacacaaaagcgagataattggctctcaatgaagagatgtaaacatccatcataatggcactgtgctgaaactgaacgctacctcagctgttctatgtactctgactggaagatgatgtcacaaacatcaactgggtgtactctcattggcttctgttacctggaatcatatcttaaccctaaactgtcagctacaaattgaaatgcacatttctgactataatttctgcctttaaaaggagagtgaaagtaatgttgagctcctgggggatcacaaactgaaaatactgccctctaattatgctaagactgatttacctaattaattaatcagaattagtgaaaattttattttccaaatgtgttttgttaagtagcagtgtttataaaaggtatttgacagaatggatattaaaggacaagatgtatgtaatcataacatctggaattttaaattttgtaattactttgcattgattttacagtactagcccctgagatttaagaaactcaaattgagaaaaattataatgtagtcaattgtacagtgaagtttttaatcaattttttcagagcagccatttgtttttaaatcttctaataaaaccacaaaaatggaaatgcattttattctctgagtgttaaacactgtttgcaaagtttcatgtaataaaccttaaagtttattacatgatattacatgaaagagatattaaaagcacatcactaatacaataatgttaaatattggtttttacaaagagtaatttataagccactggaacttcagacaatcccatttcagtaattgaaagctactctatgatatagtgctgttctttttgagcacacacagggaataattatccatctcttaccttctatcttgacaaaagccccagatttctccccaggcttaaatccagtgggagaggaggataatgggctaagctggttgcagcagcttgctgccagagggacaaaactacaatcaccttgaaatatacccaagctttccctactgaaaggagctgtcaaccgcataactgtgagatgcaagaattaccagagctattcaatgaccagttccttctaaatctagcccagccatatcccagggcaagccctttgaaagctgtgcagctcagcatgcgaacagtacaagcacctggagaaagagcaaggaaattcacttcaaccaccccaactttagggaaaggaaagtcaccaacagtgcacttgcatgactttatgctgtttcatttatttctgaataatggattcagggcaaatacttgttacattccctctgcatttacagtgacagaaaattatttttactcaatggcctcaataagagttcaaaaagttgataatatatgaaaatacactttcatatgttcacatttcctcccaagttctgacttttatgatagtcagtttatttgattactctgagaagcgagttagcatgtgacatgggagcaagagttctagactagggttgaaatgattcatcctccagttcttgctccaccacttactatctgtaaaaactctggtaacttagcatcttttatgtatagactgagagtggtaatgctacatacagcaaaataataataataaagatatggggatcagatgagacaatgcatagaagcttgttatataaaataaaaagtattacataaatataagataattaatattatcgttgttatgaaaacaatcaaatgcgttaattttaaagacacatggaagatttaaaatttagagttactttggtgccctcaaaataatgatataaatatgttaaacccttaatatttcaactcaaaaataatgttgcaaattaacttgatttataacactgactcactcaattttttttttgtttgtttgttttggagttttaaccctcccagaataatttcagcatgttttctacatgcaacaggatataatctatctatctatctatctatctatctatctatctatctatctatctatctacattcagttaatttttaaagacaaatgtattttctggtgattttagtgcacagaaatcataacctctcttatttgttttgcatttgtttgggtgacagaatgccacatataatgtgcctagagaaatacagcaatataaagattgggaaacttaaatactcctagggctctgcaggcatttttgtttgtttgttcatttatttatttgtcaatttccacaggtatcaacgtataggcattttgtatcaataacccacatcctacacaaaatttgtttacaagtgaataaggtacctagtaaagaaagctggtttttgttattaaaatatgtcagtgagattttttaagaatatagatttcaatgcttaaatattatacaagatggagtctctaatgaattacttagtattttaaggacatacacttattacatatgaaaataatttcatatttaaaatttgaattgtttaaaaattaacaaaattattggcttatactttaattcctaggaaaattgataggaaaaaagataatgtactagaaatacttcatactaacgttggactagaataatgagtgaatctttatcacatacattaagtcaacttcaaattttgtatttatttattaggacagaatttatattttagttttaaataattacatttatacactcaggaacattcagataaatacaggatataatagttcatatatgaatatcagttttattactccaaagtatattttatacataaggacagaagaaaatatatatacatatattctcttacagtggggagaaatcattagaaagtaataattagtagaatttataaaatttttttgtgattttttagtggtgtttcttttggaaaagtagagatactaaacttcaagacctttcagtaatttattttcagaatgtcctttggaaaaaagtctgatgatacttggacatcagtctgcacatgtatctgggttaaggtcaaaaataagatagtgtgtatgtgatgtgaacattgataataagacacgtaactgttttctactatactaaaataatattattaagaaatacaacctgattacaaaatgtaaaaaaaattctaaatgtaaaaatgttaaaactttaagaaactacaagaaaaataaaaggatggtgtcatttcttgaatattctatttaatatacacatgtggaaaagtaaaatgctgcatatagctctaatttcataaaggaataataacaaacactgcatttgagaatgaatttaccaacgttgtctcattatttattacattcctccaactaaaatggccagctagcatttgtgagttcagagaatataaaatattttaactttaatagtgtgtaaaagtttaatatgagggggcaaaacactctatagacatcaatttaagcttcattctcagtaaatgtatattagtaaatatctataataagatcatttcaatagttttcataactcagcaccctgactagtaacataatagccccatgtcataaagcatacaacactagatatgaaaagtcttattttgttttttcctttttttgaacaacattgttacaattgtaacacctgtaattcaagaaaaaaatttgttgaatgtggtgagaggaagctaaccaattttaatgtaggcattttactattcattagcattattttactacatagacacataattaacagataaataggctttattgcattagggtatattaaaattaaatctgctcaaaaaatggaaggacaagttggagtatcaaataaaaatttatatcaaatacttattaatatgtttgcagagaattaggtggtaagagaattaaaaacacagagacaaaagagaaacatgcccttgtaaaaacgcttgttgtccacagctggctcccacccaccttttattgtttcaaccccttgctcccactgaaagtaagcacatctgtcccttaaagtactgtcttaattctaaactcgtttctcaatgtaccctgtttaatagctatgtggttacttagggccttttaaaattagaatatgatgcaggcacagccataccctgataggcagaaatagccagaagcctactaccttttatttttaaatttatcaaagttaacattgaataatttacaatgtgccaatttcctaatagaaagaaacctccaaatcaaattattttcatagtaaggtgtgtttccataggaaatgaagcagagttagttattatctgcacttactttctctagaatagctccactattagaattggatcagagcatagagtgtaagtcagagattcttctgttcaattattgactgtatattttatgcaccatgacaaggagcaagttatttaccttccctgaacaatgttgtctaacttgtgatctttctcaaaggcttcttaaagttattaaaaagagaaatatattatataaattatttagatcattatttagtacttgctaattggtaattgctcaagggacaaatttttcccatatcccattatatttttatataataaaaatatctttgaaacagaaacaaagctatataccttttttttccattgaagagaaaggtttgttcattaaacagcatatatagctactcaaatgaaggttttgttcattaaacatcatatatagctactcataagtattaaacagaaccatgaggaacaatggagcacatgataaagtaaaactgtgtctgagagaagcagcatcttaaaacatttgtgtggcagttataaatacttgtctagcactaccttgtacagagtagtagctcattaaacatgtattgaattgatttgacattttaagaattggtgaacctctgcagcagaacatatttaaaaacccaaattgcatcaacttcacttctattcattcaatagacaaaaattgaagaccttatataatgccagacattgaattaattgctatgatgcaaacatgaatatgactcatacttcagtttcaaggaaaccttagtcaagggagagcttgaaaccttaaataaaatataccagaccaattttcttactggtcagttaacataaacgaaagtttacctagaaggctgaaatgtcaaatatttctgttcctcatttgaattagtaaaaaaacatcagcaagctattagaagcaatttcctgagaaaagtaacttttaagatatataataatgtcatgactgattcagaccaatattttgcaacccgtgtatctatcgtactctattgattttcaatatgcacaaccaagaccaagaggcatatcaaggcactcaagtaccttctgaatcatcttgaattgattaggtgtaatggagttcatgattaattgagagcataccagaagtgtgttgtaccttggggtttcactctgccttgtaaggaagtaagaattacagtgaagggaagtaagaatcacattacagaatgtaaatgaaggaaactcttaacatccctcccccaccacattcatgccttgtttaaaatccttcagaagttcttgttcttataaggagaaaggcaacccctttaacccatttatgcctcaggttgcaattttttgaatttttgcaatcagatcttggctatgacattgagcagtaggatataaataactcccacatgcttagcgttccaatattagaacactaggcataaatttaatatagtttacaatgtcctgtatgatctgaccacaatctctctagccttaccttccactagccttctcatctcactgttgtgtttctctcttctccatcgcaaatgacaagtttcagtcccatttcttccataatttattttgttacagagcatgttcatatatccagacagttgtttctacctggaatgctttctacccattcttcctttcatattactccttattctcacatgtcaagccatttgaatctatcagtcactcatagtcatattgtatctttcagccacaggctctttgcatatgctttctattctaaatacttttctatgcatgccatctttctttttatctaggtgtctctactcattccagatcagctatcccttttcaaagaagtcattcttgcctagcttattaaatcaaatctctttaagtgaccttatatcctgatagctctcttttgttgcatttatcattgcaatagatttacttctgtgacttttaagatgtttgtatcttccactaggttcttgaaagcagacattctgtctgcttttgcttactctcttaggcatatgattcatttttagagtacattcatatatagatattctagtatactacacaaaatatgcatattaaaaactttggcatgaaattggaatttatttttaattttctaattttaaacatcacttgtatttgataaaccttttaaaggtaatttctgcctgcagtcagaattagagaaaagataagccattttaatatgttttctagcacttactaaaatattttacttattatttgtacttccaaaatttttgaccgactggatttccatatggaatatttttcaactttattcctagatatagtaatgttgactgtaaaaactttgtcatttgtttaaaaggttttattttatatattttctattaaaagagtgatttttaccctactatataaaggtgaaagctttcttttccaaatgtaacttacatttctttttcaaatgtaatttcaaatgtaattatggggttgtaaccccataaattggtagatgaaaccaaagatcagtgatatgggtctagattggaagagccaaacaaatattctaaatttttatttgtgtaaatttacgggatacaagtgcagttttgttacatgcatccatcacaaagaggtcaattcaaggcttttagggtatctatcacccaaatactttacattatacccattcagtaatttctcttcacccactctatctcatcctgtcacccttctgagtcactattatctatcattatactctctatgtccatgtttctacatttgtatgtccacttatgactgagaatacacaatatttgtctttctgtgtctgacatatttcatttcagataatgtcctccaattttgtccatgttgctgcaaatgtcataatttcatatttttttggctgaatagtactccattgtgtatatatgccaaattttctttattcaatcatctattgatgacacttaagttgattcaatgtctttgctactataaatagtgctgcgatgagcctatcagtgcagatatctttttgattcattgatcttttttcttttggggagatacccagtagtgtgactgctgtatgaaattgtagttatacttttagttcttcaagaaatctccatactgttgtccataaagcttgtactaatttacattcccaccaacagtatatgagagttcccttttctctaaattctcactaaaatctggtattttttgtctttctaatagccattttgacaggcatattatatctcattgtgcttttaatttgcatttttcagatgcttagtgatgttgagcattttttcatatacctattggtcatttgtatgtcttcttttgagaagtgtctattaatgtattttgcccactttttaattggattacttgttttggggtggggggttgttgttggtgggttatttgagttctttctacatcctggatattagtcccctgccaaatgcatagtctgcaaatattttctcccgttcaacaggttgtcagctctctctgttgattgtttcttttgctgtgcagaagctttttagtttaagttcagtttgtctatttttgttgcgtgtacttttgaggtcttagtcataaattatttgcctagaccaatatccaaatgagtttttcctaggtttccttctagtatttttatagcttcaagtcttatgtttatgtctttgatatatttttaatttatttttgtatatggtgagagataggggataggagccgtgtttgtttgtttttgttgtttgagggccccgttttgattgcaggagaggcccgtctggagctgccactgcgaagacgcgggctgcagcgggggaggcggggagggggctgcgcactccacagagccaagggaagcaaggaacaggtggaagtcccgcccccttccgagttagctgggcaggagcctcctgcttcccaggtgaagctgcagccacccagctgtgtgtgcggacccgggcatttctgtgctcttgggggccagggacaggcagggtccccgcctcctggggtgcagctacagccgcccaagccatggctacggacccaagcatctctgcactctccgggcccgggaagcagccccttgccccagcaggctcagaagtgcctgctctcactgcctggcctctcccggcgccctctccgatctcagagcaaagttgaggccaagcccaggtgctgtcacaaacccagtcggctgtgcccactcttggggcagtgctgacacatcaggcccctgccgcctcagccctctctggattttgggcactgacgagcatgggctgtgacaccctctttggggctctgcggttcctggcatctccaatcttctgggcgctactgcgttccctggtgccagccatggaagctgcttgcagtaagcctggtctagccgcagcctcacagggagccggcacccgtgcgggcacctggagctgccccaccccccgacccccagccggcatgcctggctgtgcgcagtggccagaccccacctcgctccctcatacatccctcactgctccacgcctggctcacccatgtcaggtgtgacatccaggccagtagcgcgagccaagcgcagcctgccaggccaaaacaggcagaacgagcccagcaggcccgagcaaaactcaggcaaaagcgtcaccagccacagaggttcccagctggcgaaacaacaccccaaggatcctgtgacagtttcatttttcttcatgtggccattcaatcttcccaccactgtttattgaaaagggtgtcctttccccaatgtgtattcttgtttactttgtcaaataccagttggctataagtatgtgactttatttccgggttctctattctgttccattgatttacgtgcctgttttttataccagtaccacgttgttctaagccttgtaataaaatttgaagtcaggcgatgtgatacctccaggttttttccttttgctttggatcactttggccattcagggtctttttggtttcatatacattttaggtttgctttatctaattctgtgaaaaatgacattggtattttgatatagatttcaatgaatccgcagattcaatgaaagtatggtcattttaatgatatttgtgtttccagtccatgagcttgggatattttttatttgtgtcatctacaatttctttcatcagtgtttcaccaaagatcttttacttccttggttaaatatattcttaggtatttatatttatttttgtagctattgtaaatgagattaccttcttgatttggttctcagctaaattgttgctggtccatagaaacactactgatttttgtatgcttttttgtatccttcaagtttactgaattcatttatcaaatttaagagctttttctagaatttttaggtttttccacctgtaagattatatcttaaataagcaaagataacttgacttgctcttttcgagtttgtataccttttatttctttctcttgccttgttgctctggctaggacttctagtactatgttgaataggtgtggtgcaagcgggcattcttgtcttgctccagttcttaggggaagtgctttcaacttttcctaattcagtatgatattggctatgggtttgtcatatatgacatttattattttgaggcatgttccttcaatgcctagttaaatgagggttttatcatgaaaatatgttgaattttatcaagtgctttatttgcatctattgagatgatcatagggtttttgtccttcattctgtttatatactgtatcatatttactggtcagcatatgtttaatcatctttgcatccctggtgtaaaaccgaatttattgtggtgtattatctttttgatatgctgttgtatttggtttgctagtattttgctgaaaattttgtgtctatgattataagggatattgttctggagttttgttgttgtgattgtgtccttgtctggttttggtatcaaggtgataatggcctcctagaatgagttagaaaaaattccctcttcctcaattttttgaacagtttcagaaggattgctattagttcttcatacctttggtagaatttggctgtaaatccatctggcactgggattttctttgttgaaagatttttttttttattactgactcaatcttgctgctgtttattggcctgctcaggtttttaaattttttcttggttcaatcttaggaagatgcatgtttccaggaatttatctatttcctttagcctttttagtttgtgagtatatagttattcataatattctctaatgatcttttatatttcatatctcctttttcacttttgattctacttttattgtctcctgtctcttattggttagtttatcagttttgtttgtctactcaaataatctagttttgttttatcttttgtaatttttttttggtcttttttcatttagatcggctctgactttgttatttcttttcttctgcagttttggtttgtttttgcttttctagtcccttcaagtgtattattagattgttaatttgtaatctttctacttttttaatgcagatattgaagctataaagttctctcttagcactgctttgctgtatctcacagattttggtaggctgcatttccatgctgagggaattcatcaccactagacgggacctacaagcaacactcaaaggtatcttaaacttggaagtgaaaggtagatgttcaccatcatgaagacacctgaaattatacagatcactagtaaagcaattacacaaaggaagaggagaaaggaatcaagtggcaccacttcaaaattctaccaagacgcaaaaacagacagaaagaaacaaagaatttataaattttaaataaaattttagatttattaaatctgtatagttcagagctgtctttttaattcacagctgttctttcaaatatttttatatgcactagactgtagtaattcaataaaggggggaataaataaaccataaagagaatggaacgttataaaaatatctgaagtcagtacaagctagtaagtaggcctagactggaacaccattgaataaatgcagagcaaagatgaacatatttttaaagtaaaaatttagacttctcttgatttgggaagaagtattgttaagatcttagaaccagattttcacttataatatggaattcatagaattatgtagacgtatcaattgcaaacaagcaatgcaattcctgagtaactctaatttaatttttcttaccaaaatatgactaacatagtggcagtaggacagaaataggttttggtggcattagaatatattgaaactcatagcgacatccccagattcctggggtgaagttagatttgaagtatcaagggatctcattagagaagatgcttagaaagatagctgtgtatgtcaaccttgaattataaattcttttaagccataaggagaatgctttcatcagtcttacagacttatggagttgtacagctactgatggccttagaaattattgatctcaccatctcattcagcctacaaattttacagatgtgaaaaatgaaatttttagtcaactagcccaaagtcttttagctaaagacatccttaattgaaagccagactttggactctggctgtcaggtctccatctctttgttacacacttcattgtattaatatattcaactggcccatcacaaaagagttacttactatgtcaaaattttgctcatatagatttaaaaacattgaaaaatacatgatatataaaggatttttttttcttcatcttcttcacttcagtgaatgtatattgaaacctttattttttcccttttaaacctactatctaccatacttttacggactcatagatttttgaagggtccattaaaaacattagtaaagagaagatacaaccttaataaaatattttgttgtagttatttaattggcttactgctcaaacaaacaaaaggatattaactacatatatatatatatacatatatacatatatatacacatatatatatatacacatacacacacacatacatacacatgtattttttggctctgccaacaataaattcatttttattgtttatttcagtttttaccaagaaatattattattctgaaagaaagtaaagtggcacatttttttcttcttagtaattatgcatatacatttaaaataaaaaagaaagggtgttttttttttgcctgaaaaacaagtagaggagatattacagtacccctttcgaacaccatcaacccaccctcacacacatacacatctcatttgccttttgtatatattctttcatacttacatatatatatatatatatatatatatatatatatatatatatatatattcttttcttttaattctcacactatgtggagttttcactaacctcatgacattttatttaattgttgtgagctcctcataggccttcagcagatatttatgagttcttcaaaaaattgtagagcacaaagttgttataattatatctatttggaaataacctgcttaagtgttttatatcattatgtcacttagaatatctttagataggtcttacctcatctacatatttgtctttattataatactgagatatgggctcatttctacttatttccaagaaatatttaagtaaagtttatttttttttcttttggtcatttatataagtgtagtcctgatccttaattctattaacatttcttgacagtagtcaagaaaattccaatttaactacagtcataaaatgtgattgttagtatattccagtcctgtggcacttaggacaaagacagttttacagtgttaactgaattataaactctccaattcaggtttttttgtttttttttttcctggttgccaggtgtagaagagatctccagtatttttcactttctcctcatttttcttcttagagaaactgcctcaaaaatggcaatatcttctttgtgcttaatgaccctaacttcatgaagacttggcatataggtgagcacttgaatattgaaatgaagatattatgagatttagactatattaatggaggaaagaatgcataaaaagtcaatatagttattttgttgatatttttgatggtaccctggttcccaatctccttgaaaatgttacttgattcttcttgtgtatccatatgaattgtagttttttattgtgataaaatatatataacataaagtttattattttaaaccattttggttgtacaggtcagtatcataaagtatattcacgctgttgtacaagcatcaccatcatccttctctagcacttttcacctcccgtagtggatctctgtttttgttttgttttgttatgttttgttttgttttgtttttcttttgagacagagtctcactctgtcctccaggctggagtgcagtggcatgatcgcggctcactgcaacatctgccccctgggttcaagagattctccggcctcagcctcccaagtagctgggattacaggtgcacaccgccatgcccagctaatttttggcacttttttaggagagacagggtttcatctctactaaaaaatgttggccaggctggtctcgaactcctgacctcaggtgatccgcccgcctcggcctcccaaagtgctgggattacaggtgtgagccactgagcccagcccatagtggaactctgtaccattaaaaaagaactccccatacctttctccttccagcccctagcaaccacaattctattttctgtctctatgaatttgactactctaggaatttcatataattaaaatcatacaatgtttgttcttttttgtctggcttattttacttaccatatttttttcaggtttcatccatgttgcagcatgtgttagaatttcacttacttctagattcaatgcaatccccatcaaaatatcaacatcattcttcacaaaattagcaaaaacaatttaaaaatttatatgtaaccgaaaaagaaaagtgcaaatagtgcaagcaatcctgagctgaaaggacaaagctgaaggcatcacatcacactacctgacttcaaaatacattacaaggctatagtaaacgacatggtattggtaaaaatacacacatggaacaatgaaacaatttaaaaagcagaaaatgtcatgtatttataactaactaatcttcgacaaagatgacaagagcttacattgaggaaagagaaccctcttcaataaatggtgctggaaaaattggagagccaaatgcagacaaataaaactggaattctatcttccacacatgcaacaattaacttacaacaaattaaagatttaaatataagacaagaaaatacaaaaaatactaaaagaaaatctaggaaaaagtattttggacatttgtctaggcaaaacatttatgaagacctcaaaagcacaagcaacaaaaacaaaaacagacaagtggggctatattaaactaaacagcttctgcacagcagaggaaacaacacagtgaggagaaaacctgttgaatgagagaaaatatttgcaaactatccacccaacaggggcctaatgtcaagaatataaaaggaactcaaacaactgaacaggaaaagaccaactaattacaaataatcccatacaacagcgggcaaaggacatgaatagatatttttcagaagaaaacacaaatggccacaggtgtataaaaaatgatcagtcaatatcactaatcattactgattaagttaaaagcacaataagctaccatcttatacctgtcaaaatgattattattaaaaagacaacagatgttgatgaagatgtggaaaaaagggaacacttacatattgttggtgggggtgcaaactattaaaacagtatagagattttccaaaaaactgaaaatagtattaccatttgatccagtaatctcattacttgggtatcggtctgaacaaaaaagaatgaatatgtccaagggaaacctgcacttgcatgtttattgcagcactatccacaatagcaaatatgtggaaccaattagttttcatcaatagatgatggagtagagaatatttggtatatatacagcatggactattattcagtcattagaaaagaatggaatcctgtcatttgcagcaacaaggatagaactgggaggtcattatcttaagtgaaatgaatccggcacaaattggcaaatatcacatgttctcacttatatgtgagattaaaaatatttgatcacatagagatagacaatgaaactacagaaactgggaaaggtgagtcagggaagggaagaggatgaagagaactggttaaagggtataaacatacagcaagatagaaggaataaattcaatatttatagtagagtagggtaaatatacttaacaaaaatatactggggctcatgttatgaatatcctaaatacactgacttgattgctatgcattatatacctgtaacacaatttcccacatatcccataaatttgtgtaaataaaaaaattatttattcgtaagactgaataatacttcattgtctatataggccacatattgtctatttatccttagatggacatttggattgtttccatgttttggctagtgtgaatggtgctgttatgaatgttggtacacagacatgtatttgagcctatgcgttcaattctttggctatattactagaagtagaattgttatttttttaaagaaaccatgatacaatattgttaagatttgtattattttaaacagatgttccttcacctaggatacctaagagagattttttttttctaaacaatcctcaactaaaaactaatgcaataatgatatctaaaataaatctcttccaggtgcagctcatgcctataattccagtactttgggaggctgaggtgggcagattgcttgagctcaggagttggaaaccagcctgggtaacatggtgaatccccaactctacaaacaaatacaaaaattagccaggtgtggtggcatgtacctgtgatcccagctactcaggaggctgcactgggagggtcacattgagcctgggaggtcgaagctacagtaagcagtgatcatgccaacacactccagcctgggtgacaaagtgagaccctgtctcaaataaataaataaataaattaaattaattaaatatttgcattcattgtacagatggcggacaaaggacctgatgttaggtttgcctgacaatgaccctctacatcataaacagcaacatagctcttttttaatattaatgaagtgtccattaattatttcctgttttcttagaacagaaaaaaaataggagactttttggagtcctttaaactggagatattagtggtgtagatagcatgttagcaagcaggattggagaaatatttgaaaaacaagagttgacaagatcaatttcctggatgtagcatggatgttgattaaagaaacaaatttttgaggttaaattactggattacaattctgacttcattatttaccagctgtgtgatcttgggcaagttacttgattttcctgtatcttagacttctcatttatagattagtaacaatatttatttctttggtactttataacaattaaataaattgaaagacaaggctcttagactaatggaacataagaaaaatatagacatatttgttaaatatatttagaggagaaatatataaatattgtttcccaagtttatggcaaaatgattgaatgttactatttattatgataaaaaccaatacaaacaaatatatacaggaagcatgtttaattttaaatctgcatgcaacatacataatctttaattttaagtgaaaattggactgtccaactatgaaactgagagataagagatgagacctggagtcacaatgtggaaattcatcagtgtacagattatataccataacatagggtcattatataaataaaatgagggtcttgtagtgagaccccagtaatctacaaaacttaagagatttgccagtgtatacactgcatacgataacagagtgaatatataagtgataagagggcctagtgatgaaaccccaataattcaacgtatcatgaaaccacaaatagttttaatccaacagaaactttatgcagctctgaagctcaaaaactttaatggtacttgcaccttgtattagaccgttctggcattgctataaaaaaataccatgtaatttataaagaaaagaggcttaactggttgacagttccacaggtggtacaaagagcgtaatgctggcatctgctcagctcctggggatgcctcaggaaaattacaatcatggcagataatttgtaagctcccctaagagggagcacttgtcttacacagcaggagaaggagcaacaaagagagtgagggaagaggtgctacacacttttaaacaaccagatctcatgacaagtcactcattatcaggagaacagcaccaaccggatggtgctaaactattaatgagaatcacctccaagatccaattacttcctaccaggttccacttccaacattcaagattaaaatttgacatgagatttgggtggggacatatatccaatcgatatcacactcaaagacactctagtctttaaaaagtggatatcatctaaataattatttaactatatatatagtatagtatatagttatatatgtttcccattgataaaactgccattgtgctagagattatattttttaatatgaatacaagtcaacataatgtaaagcaatagaggcaatcttcatcaatttatagaacaaacccttgaaagtaaatttggctaccgagtttttgcaccagataataatgttaaaaaatggctgctagacaataaccaagaactcctgggcagatttacagatggaatgttccataattaagttttcatgggctatatgaaaagcaaaagtagtatttaatagaagaatatttagccatcctctgtccacattatatacccagattggctggagtcattctattacattaaggtgaaacataatactggggtcagttgtttgcctccagacttgccagggcagaatacagaagcaggcttgaaagtcaatttttgcctaagagttaacaccattctgtgaaaggaagagtgtgagaaaagtggacattgacagaataacaaaagctcttcttgcagaaaagcttcatgtcatcagactgcaaagattggctgaagggtagtcgaacatacggtaaggggcccacagacattttagcattgccactcgggttttgggaaactgaagttgtttcaaaaagtagataaggttgttcaaggaaaacaaagctaacctacagtcaacagttcattcatcttgatttaattgacacaatatataccattcagaacaagtatgaaatgtcacttgaaaattaaacgacaactaatatgaaatttcacaaattatcagctggataatactatcacaaaccaatctgataatattaaagagagtagataacataatggttaagagtaagagcactggagtcattcagataaaggttccatttctgtctctcaacttaatcaccttgtgatctcatgcagtctcattatccttctaaacttgtgtcctctgttgaatagagccgtatcataaggattttatgaaggtaaatgaaataatgaatgttaagcaatcagtacaatgcccagctgttgtagttggataatgacccccgaagatgtccatgtcttaatccccggaacctgggaatatgttaccttacttggcaaaaggaaagttgcaaatatgattaagtcaaagctcttgagatggagagattatacaaattgatccaatgtagtgacaaacgtgttgataagagggataaaggaaagccagagtcagagaaggagatttgaggattaaagcggagagtggagtgatgcaaggccatttgccaaataattcaggcagcctcaagaagctgagaaagacaagcattctcccctagaatctctagaaggaacatagcagtgctgacctgttttagatttctaacctccaaaactgtaagaaaataaattggctgggcgcggtggctcacgcctgtaatcccagcactttgggaggccgaggcggcggatcacgacgtcaggagatcgagaccattttggctaacacggtgaaaccccgtctctactaaaaatccaaaaaaaaaaaaaaaaaaaaaaaaaaaaattagccgggcgtggtgttggccgcttgtagtcccagctacaggctgaggctggagaatggcgtgatcccgggaggcggagcttgcagtgagccgagattgcgccgctgcactccagcctgggcgacagagcaagactccgtcaaaaaaaaaaaagaaaacaaaataaatttgtgtagttttaaaccattaagtttgtagtgatttttttacaagtataggaaattaatatactaacataattacttaaatttagctattattattgaaaaatatgtactttacaagatgagaaatctatttttcaatttttaattttgtaggtatatggtgtctatatttaacgaggtacatgagatattttgatgtaggcatacaatgtgtaataatcaccgcaaggtaaatgggatatccatcacctcaagtaatttaccctttatgttacaaacaatccaattatactctttcatattttaaaatatacaattagatggttattgactatggtctccctgttgtggtatcaaatagtagaaggtattcattttttctgtttatttttttattttttgtactcattaaccatactcaatcccccacttcaacacctgcactgcctttctcaacttctggaaaccatccttctactttctatctccattagttcaatcattttaatttttacctcctacaaatgagtgagaacatgtaaagtttgtctttctgtttctggcttatttcacttaacataatgacctccagttccatccatgccgttgcaaatgacagaatctcattctttcatatggctaaatgctactccattgtgtatacatactacatgttctttatccatttgtctgttgatggacacttagcttccctccaaatcttggctattataaatagtgctgcaataaatatgggagtgtacatctcttaaatatactgatttcctttcttttgggtgcatacccagcagtagcattgctggatcatatggtagctctatttttagttttttgaagaacctccgaactgttctccctagtggttgtactaatttacattcctatcaacagcgtatgagagttccctttctctatatcctctttagcatttctggttgcctgtgttttggataaaagccgttttaactggagcaagatgatatctcattgtagttttcatttgcctttctcaatgttgagcacatttttatatacctgtttgctatttgtatgtctcctcttgagaaatgtttattcagatcttttgcccatttttgattattatttttcttatatattctggttattaatccattgtcagatgaatactttgcaaatattttctcccattcattgggctgtctcctcactttgctgattattttgtttactgtgcaaaaagctgtttaacttgacgtgatccccatttgcccatttttgttttgattgcctgtgcttgtggggcattactcaagaaatctttgcccagtccactgtcctggagactttttccattgtttcctttttagccttttcatagtttgaggttttagatttaagtctttaatcaattttgatttcaattttgtgtatgacagaatagagtggggtagtttcattcttctgcatatggatatccagtttccccaacaccatttatttaagagactgtcctttacccaattgtgttcttggcacctttgttgaaaatgagttcactgtagattcatggatttctttctgggttctctgttctgttccattggtctatgtgtctttttttatgttaggaccatgctgttttggttactatagttatttagtataatttgaagtcaggtaatatgattcctccaattttgattttgttgtgtaggatagctttggctgttctggggttttttggggttccatgtaaattttaggattatttatctatttcatttaagcatgtcattggcattttaatagagattgcattaaatctacagattgctttgagtagtatggacattttaacaatattcttacaatccagggaacatgaaatatatttccacttttggtgtcctcttcaatttattttatcaatataatacagtttttattgcagagatttttttcacttctttggttaattcctagatatttaattttatctgtagctattgaaatgggattagtttgttgacttccttttttttttttttttttaagatggagttttgatcttgttgcccaggctgcagttcatgacatggtcttggctcactgtaacctccgcctcctggattcaagtgattctcctgcctcggcccctcaaatagctgggattacaggtgtctgccaccacacccagctaatttttgtatttttagtagaagtgggatttcaccatgctgggcaggctggtcttgaactcctgacctcaggtgatccacccacctcggcctcccaaagtgctgggattacaggcgtgagccaccatgcccatctttgtttatttctttttcagatttttcactgttggcatacagaaatgctactgatttttgtgtgttgattttgtatcttgctactgtactgaatttgtttatcagttctagtaatttcttggtggagtccttaggttttccaagatataagagcatatcatctgcaaacaaatataatttgacttcttcctttccaatttgatgcaatttttttctttcttttttctgattgctttagctaggatttccagtactatgttgaataactgtggtcaaagtgggcatccttggcacgctttctgtttttccccatttatgatactagctgcaactctgtcatatatggcttttgttgtgttaagctatattccttctatacccagtttttgtagagtttttatcatgaagtaatgttgaattttatcaaatgttttttagcaacagttgaaattatcatataggttttgtccttcagtcagttgatatgatgtctcacatccttatatccctgtgataaatctcatgtgatcataaggaatgattttttaaatgtgttgttgaatttggtttgctagtattctgtttttgcctcaatgtttatcatggacattggcctgtagttttatttcttttcttttctatttttttaatgtgtctttgtctgattttggtattaggataatactggccttgtagaatgagtttggacgtattcactccttctctattttttggaatagtttgaataggattgatattaggtcttcttcaaatgtttggtagaattcagcagttaagccattgggccctggccttttctttgctgggagatttttatcatggcattgatctcattacttgttattggtctgttccggttttggatttcttcatagttcaatcttggtaggttgtatgtatctagaaatgtattgatttatattaggttttgcaactgataggcatactgttcctcatagtagccacaagtgattctttaattttctgtggtgtcagttgtaagtctccttttcatttttgattttatttatttgggtctcctctctctttttcttagtctatcaactttgcttaccttttcgaaaacaagcaacattttgttttgttgatcttttttattgttttcttcattttaattttatttatttctgctctgatcttttttttttcttctactaattttgggttccatttgctcttgatttcttattctttaataagaattgttgggttgtttatttgaagattttctactttttaaaatgtaggtgcttatagctttaagcttccctcttagtactgcttttgctatatcccatagattttggtaagttgtgttcccattgtcatttgtttcaagaaatttttcaattttcttagtttctttgtgggcccattcaggagcatactgtttaatttccatatgtttgtatagtttccaaaattccttgttattgatttctagttttatttcattatgatcagagaagatgatttatatgatttcaatgttcttgaatgttttaagacttactttgtgatgtaacatatggtctaacattgagaatgatctatgtgcttaggagaagaatgggtattctgcagcccttgaatgaaatattctgtaaatatttattcggtcaatatttattcagtcaattggtctatagtgcagattaagttcaatttttttgttgattttctgcctgaaagatttgtccaatgctgaaagtgaggtgttaaagtctacaggtgttattatattggagtctatctctctctttagctctaataatatttgcttcatatatctacgttctccagtgttgggtgcatatatatttataattattatatcctgtcattacaaatctattttttaggtgaagcagttatttttattttaactaaatttatattattaaaaggtaactatttgaaaaatataaaaccatataaagtaaatgtaaactgtccttttgactcaagatccatggcctaccatttcggatataaagcttcaataacagattaatgcatatcttttcagaaatgtttcaaaaatttagaatgctttttcatgctttattgcttttaaatttcattatatagatttgtttatttatgtcttattgtgtccattattgctatttgtgtttggaacctctcttactagtttacacattttgaatttctatcctttttttttttaaatgaaataaccctttatcattgcgagatgattttcaaaaataactttgttttcttttactatgaatttcacttttgctgactttattatcatcacttcagttttcttattgtttacatttacaaagtacatattttatcttattacttttaacctttgtagtcttttatgtttagtatgtgctcttgtacagagaatatagttggttccctctttgtttaatgattatggcaatctttgtcttttaattagagtgcttaatccatttaccagtaatattattattgacatggttatgtccgtcatcttgctatttatattttgcttgtcttgtaagttttgtgtttgtttgttttctattatcctatcttctttttggttgcatacatttttgttatttccttttctgttgtttattggctctttttcactgtgcccctcccttcttttggtagtttttatgacttacggtatacatcttctatttatcagaacagactctcttgaaatcatttttgttaaaaatttaagaaacttacattggtatactttcattttccttgctaagcctctgtgcaattgttgtcacacatatgttttctctattttccccttcctatccctcatttcctccccctttccttcctctctccatccctctcaatataaaatatatatccattttgtttccctatatacatagatatggatgtagatagaaatagagatatatctgtatctctgtatatgtatcttcaaaatgtatcatcatttttattaattatattttggagaagttttataaataattattggaagacttttatatttaatttttaatttttctatttttttagaggcagaggtcacactatgttgcccaagctggtctcgaactcatggcctgaagtcatcctcctgcctcagccttcttaattgctgggatacaggcataacccattatgccggatgttttttgtataaactccaacttttataatgtattattgtattttaacccagcaaacctgattctgcattcttatcatgcagtactgtttgtggtaggttttctgagcttttgttcatgagaaaatacttttattttgcctgttttttgtgaacactatttgaaggacacttatttctggagtataaattatatttcaacaattatattttccctttctttagcctttagtgacttcattttattgttgcttttatttaaagtatgagaccacagtcaatattcttccctatgtaagtagaatgttttcccttctgcctgctttaaaattttctttatatttcaattatagcattttgactatgttatgtacatgggggctttttaaattttactttgctcagtatttgatgtgattctttcatcaccagactagtgttttctttcaaattgcaaaaagatgttttgccatgaagtaatcagcctcatacaatttctctttccacctggaatcccagtgacacataaattagactgcttaatattttccacaggtccctgtggcacgcttattttatttaacactctttttctctacggattactttcaatgatttacatttttctatcttcaatctgaccaataatttcttatacaatattctatctgttgttaaacctaatccaatgccttctttttggttttgaatattggagttttcagttctagaattttcatttagttcttttttgtaatagttaccatttttctactgaggtttctttttgttaatttactgtgtttatatttttctctaaatactcatttataataacaaaataaaatattgaaacagctaatcctggtataccagtcataggtatttgtttctaatgatgatacttttttcttgcttctccatatatctagtaaatatttattacatattgtggatattatattgttcagtatctaattaactgtgctcctttaaagtattaaatttgttctggcaatacttaatctactgatatataaccttgattatttccagtcctgtttttcagctttttgttttgttttgctttgttttcgtttttagtgtgattctagagtaaagtttattctaggactattgcagcccaactacaaaagcttttctatattgcatatcttttctggactcttgattaaatgattcgggtgtttagcaaagcattttgttatattatacccagtgtgtcttctagcactatgaaactttagatcaaagctactcagtattttttctaggcaaaaactttcaatatatcatcttgggcatgtgcaactcagtgcctggtaaaagacaccaaagcaacatcatgcaaagtcctggagccttttgtcttcataccttccattggcaattacagccatttcaccattgttgaactctcatttctgcctcctcagaacaatgagagcactatgcttttcttgggttctaccattctgccttccaccacaataaaaaaaaaaaaattcttccaaatagaaaagtgatgtaactgtgaggttcacctcttgtacttctcacatccctattctgtttgttattcagattctaaacactgttgcttcacctattttgtctgttcttatagtgttttatagtggtagagctagcctgtcatggacataagtggaaattatatatttatgttatatcaagttatattatatataaataatttccactctttagaaattcttcttctctctcttaaatactgtacatatttagaacttttaatctaagacaggacataagagaagaaaaaaatttaaacaatctccacaatggaacaagtttggtttcttcttaactattctagtttttattaatatgattaaatatgaaatcaaaatataataacttagcatttcacatgcttaggctaattctgatacagcgaccatgggtgatatactgtttgttgattgtttttagattttcaaagctctgagatataagtgtattctgttttcaactatctgccaagagcataaatagttgagctttaaaatgacacctggctacatctctatttgtctaaataaatgtctgtatgtgacatgtttatagctgttggaacactgcttttcttcaccctgacagttctgtagagatacagtatatcgctatatggaattcaaagcatgttcaacactttgtgctaaggcattgctgcctcaaaatgtttacaatttgatcctctgctgcatctattaaatctactacaaacattacatgttgcacaggactttatatagctgaataaaagataagcataaagttttctaagacttaaaagtattcaaacaaaaatatatttgtatcatctaagctaaatgcactggctaaaagacctccacactgtttttgtgaataaagcataacatgcaaatacactatccagggttgggaaatataaatcaatgattctataacaggttgtctcatttaaaaacaattttaaaatattgaatacacaaacagacttaatagtaggtaaaaataaaggtatcctttagtcttctgagatgaatgtttatatatatataaatatatactaaatgcacatttttttcctctatctctttactttgagaagataaaaagtaacaatgtggtcctcgcaaagcttctctggagacacctcttctagaagtagtgatttcacctatttctaagatctagcccaggatataattatttattagacgattatgctgaagtttaaactagtctgaaaaaatctgccaaaaaaatacccaaaaaacaaatcatatatccctggtgaaaatattttataattccacccttatcccttatgtttattatgacttaattatagtagaagttgtcttactatcaaatacttctaataattgaaaagaaacagtggaatcaaataggaaaccatgaaaaatcatttgtctgtattaaagatttgttttgacataaaccatgtaagtgtacactttttcctagtttatatttaaaacttcttcttgtggcaatagtctgctaattagagttccatgcagccttctcccatgtgcaaacaaccatcatgaatataccataatctccaatttctgttaattttagatggaagaaaaatgtaattcagaaaatcctgagagcatatgtcatctgcacagtcaattattttttcagtaattttcatccttatgtaatagtattaattttagcaactaaactttggttgtctaaacattagacaaaatttcatagaaacaaattcatatttcatttgtgctcatattttttactgtaaataatattcactaaaattcaaaaataccataacaggaacatgttgggcaaacaaatttgagatcaaacacatttaaatcttaattgataaaacaagtggagggagtagaaatgtacatcatctccaggtactagccttccagtcacaaatattcggcttcctatagatattagacactatattttgctgtaggaatgaagggtgttgattcaatgagagtcagttatgtaagggcctgttaagagagcttaaagtaccatattcaatgttccttttatcttgtagaatgttaagcttcataagagcagggatgttgactattgtgttcaccaccgtgtatccagtgtgtagcattgtgctttgcttgtaataaaaatcaatatatatttaatacagaaaactcatttatacaacacacaacatacacacaaaatgcaaatagcatacaagaatatttaacaatataggacatcaaataatgattctgggagctttccaactatcaaattttgacaaaagttagaaaacaataattactgaaatagaaatgagggagcaacacatttgcatattattgatggaagtgtgaattgatacactgattctgaaaaacataattttagactactatatgtgctcaaaagtctcaaaaatataaatatacccctgatgtctttagagatgtatgtaaagatctgtgtaagatactttttacagttatgctcatgtccataaaaattgcaaattgcctaaagatctaacagaggatttattaaataaatcttatgtatgtaataaaatattataatgaaatattatgcatatatttcaatcatgtattcacatattctttaatgacataaaaatgcttacaaaacatgagaaacagaactccacatttataaaatcacattgattataagacatacccacacattcacaaaagaaatacaacaaaccagaaataattatttattttaagggtgataaagtctttgcaaacgtttattgtttctctttatttttcttttttctataataaacatactgtgtagaaataaggacaaaattgtcttaaaaggcaatttttaattcttgtatccttttcttgtcctttaaaatatcaccaggaaactagccttgattattatatttagtgagttggagacaggatgtgacgttttatacacattaaaatgctagcctagcatgactttggcttaaatttgagtgtgtcacatgtgataaaatgttagcagtaaaaagaacattagagaggccctaattaaaattccatctttagcagtaagtggccatgcactatgtctacattaagctttccatcaaaatgtgtttcaaaattggtagtacttatacttgtttgagaaagagaaattgctatacagacaataatacaactaaccagccaatattcctcacactattaagcatgtacgtttttaaaacatggcagtaaatgaatattcattaggcatgaaacctttaaaattgaatattcatgacagtttatagtttctaagtgaaaagtaaatttttctttttaaattttattttaggtgcaggggaacatgtgcaggtgtgctatattggtaaattgtgtgctgcaggggtttggtgtacagattcttttgtcatccaggtaataagcatagtacacaataggccatttttctattctcattcccctcccacccccacccccttgtaggccctggtgtctgtggttttctactgtgtgtccatatgtactcaatgcttagctccaacttgtaagtgagaacatgtggtatttgtttttctgtacccctgtaagttctcttaggatgatggcctccagctctatccatgtttctgcaaaggacaggatctcattcttttctgtgggtgcatggtattccatgatttataagtaatatatttgctttatccagtctaccattggtgaacatttaagggtgattccatatctttgctattgtgaatagtgctgtgatgaacatatgcatgcatgtggctttatggtagagtgagttatattcctttgggtattcaataatgagactgctgggtcaaatggtagttcctctttgagatctttgagaaatcaccaacctctttcccaaagcggtgaactaatttacattcccaccctacacacaccagggaagtgtataattatttgccttttcccccaatctctccagaatctgttattttttttaccgtttaataatagtcattctgactggtgtgagttggtatctcattatggttttgatttccatttcttttttttctttatactttttttttctttttaattatactttaagttctgggattatgtgcagaatgtgcaggtttgttacataggtataaacgtgccatggtggtttgctgcacccatcaacctatcaactacattaggtatttctcctaatgctatccctccgttagcccctccaccccaccacaggccccagtgtgtgatgtttccctccctgtgtccatgtgttcttattgttcccctcctacttatcagtgagaacatgcagtgtttggttttctgttcctgtgttagtctgctgaaaatgatggattccagcttcatccacgtccctgcaaaggacatgaactcatcattttttatggctgcatagagccaaaactgtgccacatattctttatccactgtaatattgatgggcatttgggttggttctaaatctttgctatcgtgagcaatgctgcagtaatcatacgtatgcatgtgtccttatagtagaatgatttataatcctttgggtatatacccagtaatgggattgctgagtcaaatggtatttctggttctagatccttgaggaattgccacactgtcttccacaatggttgaactaatttacactcccaccaacagtgtaaaagtgttcctatttctccacatcctctccatcatctgttgtttcctgactttttaatgatcactattctaactggcatgagatggtatctcgttgtggttttgatttggatttctctaatgaccagtgatgatgagctttttttcatatgctttttggctgcataaatgtcttcttttgagaagtgcctgttcatatcctttgcccactttttaatggggttgtttttttcttgtaaatttgtttaagttccttgtagattctggatattagccttttgtcagataaatagattgcaaaatttttctcccattctgtaggttgcctgctcactctgatgatagtttcttttgctgtgcagaagctctttagtttaattagatcccatttgtcaattttggcttttgttgccattacttttggtgttttagtcatgaagtctttgcccatgcctatgtcctgaatggtactgcctaggtttttttctagggttttatatggttttaggtcttacatttaagttttaatccatcttgagttaatttttgtatacggtgtaaggaagaggtccagtttcagttttctgcatatggctagccaattttcccaacaccatttattaaatagggaatcctttccctattgcttgtttttgtcaggtttgtcaaacatttccatttctttaatgattaatcatgtggagcatttttagtatatttgttgaccacatgtaagtctttttttggaaagtgtctgttcatgttctttgccctctttttaatggggttgtttttcccttgtaaatttgtttaagctccttagagattccagatattagacctttgttggacgcacagtttgtaaaaattttctcccattctgtaggttgtctgtgaactttgttgataatctcttttgctttgtagaagctctttagtttaattaggtctcattttttaatttttgtctttgtcacaattgcttctgatgtctttgtcatgaaatctttgtcagggcctatgttcagaatggtattgcctaagttgtctcccagggtttttatagttttgggttttgtattgaaatcattaatccatcttgatttttgtatatggtgtaaggaaaggatccagtttcaatcttctgcctagagctagcaagttatcccagcaccatttattgaacagtaagtcttctctccatttcctgtttttgtcaactttgttgaagactagatgattgtaggcgcatggcattatttctgggctctctattctgttccactagtctacgtgtttgtttttgtaccaataccaagctgttttggttactgttgccttgtagtatagtttgaagttgggtaattggatgcctcgggctgtgttctttttgcttaagattaccttcaccctttgggctcttttttagttccatatgagttgtaattttttttttcaagttatctgaagaatgtcattggtagtttgataggaatagtaatgaatctgtaaattgctttgggccgtatgaccatttaacaacattaattatttctatccatgaacatggaatgtgtttccatttgtttgtgtcacttctgatgtctttcagcagtgtttggtaattctccttgtagagatcattcacctccctggctagctgtattcctaggtattttattccttttgtggctattgcgagtgggattgcattcttgactgggatctcagcttggatgttgttggtgtgtacaaatgctactaatttttgtacactggctttgtatcctgagactttgctaacgtgttattttgctttactatttttaaaaattttaggtttttactgttgaggaaattgttttcccaaattcatagttaactcatagatcatagtctcctttgcatttgctttgaaaacatatagaaagttaataaaatgtggacttacaggcccacccataaccactctgtaggttagcatccatgctttcttttttccttaaaaagagacatcataggtcatactgaaaagacaatggagttactagctagaaggattctgaatatctaaatcactttttttttttttgagacggagtcttgctctgtcacccatgctggagtgtagtggtgcgatctctgctcacggcaacctctgcctcccaggttcaagtgattctcctgcctcagccgcccaagtagctgggattacaggcatgcgccactgtgcccagctaatttttgtattttcagtagagacgggtttggccaggctggtcttgaactcctggcctcaggtgatctggctgcctcagcctaccaaagtgctgggattacaggtatgagccaccgcacccggcctctaactcactttttagataaaagctacgcaggagagcagcagcacaatcagtaatatcccaattcaaatttgcatgacaaatatcacggagggtttgagatttgcagtagtcagcattgattatacagactaataaaaaaactggatccttaaagtgagatattgacaaaacaaaattgaaacacatattattaacttagtagggggtgacagattgcaagagaataaagtaggttggtcccttggtgattaaaatgaaaacacattttaaaccataacctgacaaaatcatttgtgcatcaaaccccaatgacatgcaatttacccatgtaacaaacctgtatatatcgcctctgaagctgaaagttaaggaaagaaaaaaaaaaaaagaggaataagttaaagtaaacaataaccacaagaaaccataacccatggtaacttggaaggcagaccaaagctgactcagtttataggtctaaaagtgtttgaaaaatacattcttgcggtatgttactattattgacagttttagcagagtattacaagaaagagatgagctcagaaaataattagcagatttaaagtgaagtgaaagggaataaggaagctcggaaaaaggtaagagttgaaatttaaaatgctttgaacaaccaagacccagagaaattgggtcagctgaacagtgtatcatatttgtgccaaagatcagataaagcacatgttctgcccactcaagcttgatggtcacaagcttatctgactttaaggtgagatacaaagaggcatgacagcaagatagcaaagaaatgaaacatagttgagaataatgtctggtggtttgagctacttgtacctgaaactgactggaagcaaatagtttgccaagttcttaaaagatttatattgccaaatagccacaagtccgggttaaaaagtatttgactctgcaatcctagaaagaactcttggacatgagcatgaacatgagatgggttctgtaagctggacagccaagaaatagatatttttaatgtgtaatttagataaagcatggaggatgagaagaaatagcattcactaaatttggttttcttaacaaggtagttactcccagggaagatcaggtctaattgagaagctttctttttttcaccaggaagtgggtcctcacaatatgttcttagctggattccataaatgccatggatcaatgacttctgtgtgccttctattctcgtgttttccaaatgcgggttgttattgatattagtgtatctgtatctgtcattatgtatatatgaaggatccaggggcagaataaatggatttttaacatgcagattacaaagcatgaatatgctactacatgtggacctaacataggtatcaggttggtgcaaaagtgatggcaaaaccccaattacttttgcaccaacctaataactgcaattagccaaagattccggaaataaactgaatactgtgaataggatttgggggtaagtggaagatatgaaaaatagcactaatgaaatactgggtggccaaagggtagactataacaaagacactgctctatttttatcaaagcatatctacctccttttggactcacagttaaagctatgatttcaggccccatttcaattagcttgggatcatatgactaacttgtgtccacacaattttatgcttgattctccacattcacctccttaagataaagacagagacatttgaggattgtaggagcctgttgttactgcttggaggcaaaccactcaggaaggaattagcaacagatgaagtttattaagccactgagatttctggatgtttggtggtggtggtggtacagcaattagtgttaataactctgaataatataaatacattttagcaaaaatataatgaaaaattataattttataatgaactattaaaatatttttttaaaatatcatattttagatatatagatataactactcctttaacttactagaaagaggtttaagcttttcctatttctgtgcaaagacatcaaaattcataatttttcagtctattatttaaagaataagaagaaaaaccctactacttttttttttagtgaagagatcaggagagctattccatttggaaaacactgattttcagcagggcccattttcccccaaattcaaggaacacaaaacaagttaattcagaaatgtggatatagatgactgtctagaaataattaatgataacttctgaagagctgtcataggtaatgtgatgtctttaaattaataacagtttacatcacccatattgcgttccacgaaaactgctgttccattctatttgaccttaattggtataattgataacagctacagcttggagtgtcattttaatcatgttggtagaagtctcctgacagaagaaaataaaatcgctgttgtgagttatttattattagtgggaaaacagaaaggtaaaagaaatgactgttttttttttttttaaacctgcaactttgggacttctaaattataacaggcaatttactaatgggattaaagggcttgtgctaattgctaaaaaattaatgaaaactagttcatatgtaatttgacataattgaaaaaatgagaaaattagttggttgcaggttagagatatcaataaacaattcaagacaaagagaatattctaaaatgttctaaacgttagtacgacccctggtgaataagatttctataacagatatgctgtttagcgctgattatttaaaagttcaatttttaaatttgaagtagaaattgaaaattatgctagttataaatgtgactatttcttgctgatttgaatgggttgttcagtgtgtgcatggagacagtgtgtacatggggttaaatgttgaaaaaaatagatattgttagtttaatagtctttttgtgataaacagagtcaatagtgagtctcctaagccctttttctaccaaatattgctgaattattataagataatgagctggtctttccaagaaaacattttgtctctcacctttatcactactttttagatatttctttctgtttttaaaaaaataataggaaggcaaaattcaacaataggaactcaggattttaatttttttgacaactgaaaaatgtgtactctacctattgaagaaatctgaattctgagccatttcttatttcttgctttgttcttgttttttaaatttgagtaacatgcattgtctcctttatgacttataacaattgagtcattatgatatgtttgtagcttagtgtgtgatatggtttggctctgtgtacctatccaaatcttatcttgaattgtaatccccacgtgtcaagggagcacccaggtggaggtaattagatcatgttctcatgatagtgagtgagttctcacaagatctgatggttttataagtgtttggaagttcctcctgcattcactcactccatcctcctgacctgtgaagaaggcatctgcttgtcctttgcctcctgccatgattaaaggtttcttgaagcctccccagcaatgcggaactgtgagtcaactaaacctctttcctttatgaattaatccataaatcacaattgtctcacttttcttctttgattcttttgctctaactcctagcaacaaaatctcccatgatgcagtgttaactccaccagtgcacacaaagatcatgacaaatattacaggacatagaatggtgcctggctcatagcactttagaaattaaaaaacaatattaaaaaaaaaaccacctatgcagttcaactgtaacttagacttctttagaagctattttacttagctaactcgtggctagtgaaatcactacagcagtggacatgtttgggggcctcctttcccatccctctcctggattgtctctaattaaattctttcatgtctttatctgtatcttcctagctttcgtctatcatgggggaaaaggtgttattcacactcactaaaactcctttttttttttaatctaaatccttgcttttatcactcttcttattccagaactttgcttccaaatttattatcttcctgtctagcaccacatgcctcttcgattgcgcttgttctcctctgcatgcaaatacacgcagggcttgactgttccgaaaatcaaaacaaaaagagaacaaagtacttcattttattcaactgtactttctcccagacaatctggttttctcctttctgcaactgtacaaaattgtaaaacaagtaatgtgaaatattcagtaaagtttttatctctggtttgtagtcagcatttgttgggggggaaaaaagttaaatacttttagtttcccagttgtctcaaacctgtgactcttatttcttgtcccagtatcagcagactatttggttcctattttgcaataatagtatttatttatcagaactccctcaactcactacttccaagattgcaaattcacctacatttgctcccaccattttcccttccttctctattacaatgaaagctttttatcaagggcgccccgtaaagtctttgttcacttctgccccttctaattcccactttaacaatatttgtcacataaatcttcttcaataattccaaaatttctcagttcatctttctgacttccaatcaagtcatcacaattacatggagaatggttctttaaagcacaaaatggtcctataataataatgcctttgcttaaaatcccttaactacttattattttattcaggcttttaatctcaatatattttagttctctgaaaaatagccataaacaatttatttaaatagtatacatatttcattattaaacatggacattttgttctagccttagtattctcttaaaattcgatttccaaagctataaaattatttgtgataacttttattttgcactatttgataaaagtaatgtgcctggaattggtggtttgttggtctcactgacttcaagaaagaagccgcagaccctcgcggtgagtgttacagctcttaaggcagcgcgtctggagttgttcattcctcctggtgggctcgtggtcttgctgggctcaggagtgaagctgcagattttcgcagtgagtgttacagctcataaaagcagtgtggacccaaagagtgagcagtagcaagatttattgcaaagagcgaaacaacaatgcttccacagtgtggaaggggaccccagcaggttgccaatgctggctctggcagcctgcttttattctcttatctggccccacccacatcctgctgattggtagagccgagtggcctgttttgtcagggtgctgattggtgcatttacaatccctgagctagatacaaaggttctccacctccccatcagattagttagatacagagtttcgacatacaggttctccaaggccccacgagagcagctagatacagagtgtggattggtgcattcacaaaccttgagctaaacacagggtgctgattggtgcattcacaaaccttgagctaaacacagggtgccgactggtttgtttacaatccctgagctagacataaagactctccaaggccccaccagagcagctagatacagagtgtcaattggtgcactcacaaaccttgagctaaacacagggtgctgactggtttgtttacaatccctgagctagacataaagactctccaaggccccaccagagcagctagatacagagtgtcaattggtgcactcacaaaccttgagctaaatacagggtgctgactggtttgtttacaatccctgagctagacataaaggttctccaaggccccaccagagcagctagatacagagtgtcgattggtgcactcacaaaccttgagctaaacacagggtgctgattggtgtatttacaatccctgagctagacataaaaactctccacgtccccaccagactcaggagcccagctggcttcacctagtggatcccacaccagggctgcaggtggagctgcctgccagtcccgtgccatgcgctcgcactcctcagcccttgggcggtcgatgggactgggcgccgtggagcagggggcggcattcgtcagggaggctccagttgcacaggaactcatggaggtgggggacggctcaggcatggtgggctgcaggtcccgaggcctgcccggtgggaaggcagctaaggcccagcgagaaatcgagcgcagcgccggtgggctggcactgctgggggtcccagtacaccctccgcagccgctggcccgggtgctaagcccctcactgcctggggcccgcagggccggccagcggctccgagtgcggggcccgccaagcccagaactccagctggcccgcaagcgctgcgcgcagccccagttcctgctcgcgcctctccctccacacctccctgcaagctgagggagccggttctggccttggccagcccagaaaggggctcccacagtgcagtggcgggccaaagggctcctcaagtgccgccgaagtgggagcccaggcagaggaagcgcccagagcgagcgagggctgtgaggactgccagcacgctgtcacctctcagtaacagccaaaggttaaaatattttcttgtaaaaaaggcagataaagacaagtttaagttgtagatatctaattttccctggaaaagaaaatatttccctagtgaagtaaagaaaatttaaatatacagtaaaagaactttacagaagatgtgaccccaatgaaggaaatagaaaagataaacatggaagtttaagtaatactttattttcaccattgacaaggtgacttaggctttcgaatcctacaaaaagctctgaatatttaagaataacattagcttgtgaatatttaagaatcataataattatgtcctggagagtttatttctgtacaacagtgggaggcaagattttatgtagctcaatctttgaagcacggtaatagtatgattttgcacgtgatatgcaaatgtgtatgtgtatatacttatatatttacacaaaatgttactaaaagaaaaaatacattttatatagaattttaccttacatattattttatttaaactacatttgagtctgtgcacattaagggagaaaactgtaaaagcaagttagttgcagaatgattaagaaacaaaatctgagtgtagactttccaaatcccttgtggattgataatgctatgaatgtgtgagagactaaagagatttccattgaaaaactctaagaaaccaggaggagggtctgatcctaaaagacagagttggtgctgataagatttgggtttgttgcacctttgactactatcaactcatacacaggtggtttatgaaaacccaatgcaattttaacaaaagaaaaaaagggaggatcgttcatcctatctattcagacacactataaagccacattaatacaagcatgttaccaacatacataaataaaacagaaaggagaggtcatttaaatatgagagcttgatgtttgataaacatgacatcaaaaatcagtgcagaaataatggattttaaagtcagtgatgggaaaaaatgatttactatgtgaaaacatatatataaagatatgtggatgtaattgataggttgttatataaatacatacatgcataaatacatgcacacaactagtagaagacggtgaacagaagagggtgtagggcaataggtcatgctttggagaaaaacttaataaaagccctaaagggtaaaaagcaaaagttaaaaaaaaatcaatgggtttaactgtatcaaaataatgatttctattcaatgaagtacaaaattatgcaattcacagcagtaaaaatctaaatggttaataaacataaaatatttaacttattcatgaagaacaaaaatacaataaaaatgtattatttttcatgtttaaatcatcaaatattataaaatgggataatatttatttcttacaggtttgtcatgagatggcaacttgtatatagcattggaagtcaggtaaatttgctgcaatctttctgaaaaccgatttaatgttatacatcagcaacttttatatgttcataatttatgacctaggaattctatttctagaattctgtcataaaggaagcatcaaaacaagcataaacaagtttctcataacatcatttattataataaacactggaagaaacctaaaacctcaaaaatatggcaaagcttaaataattaatgatggtctttcagataaagctgtgaaaaattgttttggagaaattttaatgaatttttaaaattcttatattaagttggaaaaaacatactgagaaacctgttgtgttgaaataaaacagtaatcatggtaatctatttattctggaagtcaactagtagactgtaagcaagaaatgagaatattgtattttacctctaaatactcaacagtccagcagttagtatatctataccaatcactcaataagtggttattaagagaaaaaaattgaatttaaatttatttatattttctatacttttatgtaatctggaaattatcaccaatgagtgcatatcctttttataatcataacacatagtactatttaaaacatatatatgttacaactccctgtaagggttgggaataaatatgctctttgcttttctttgctggagtatagttaaagaatcagaaaatttatagaatactctgatcttttcagtaaatttatttatttatttatttatttttgagacgaatctcgctctgtcgcccaggctggagtgcagtggcgcgatctcggctcactgcaagctctgcctcctggggttcagttcattctcctgcttcagcctcctgtgtagctgggactacaagcgcatgccaccaggcccagctattttttttgtatttttagtagagacggggttttaccgtgttagccaggatggtctccatctactgacctcgtgatccgcccgcctcggcctcccagagtgctgggattacaggcgtgagccactgtgcctggcctcttttcaataaatttctacctgaaaatgtctcttttatatattggtaaataaatatgtcaatgagaatttagaaatgaagagagcttgtttgtcctttagtttgggtcaatagagacaaacaatttttaatatattaactcagctttctcttttgggtttgttaggaatttttaatacaaaacacttttacattcatgaacttgatacagctcaaataatgaaattatataatatttaatgtaaaagctttctaatttacaactgaactgttttttgttcaacatattacacaacaatataaaaggtatttgctttgggacaatatgccaaattatatcttctatattgagctataattacataaaggagtatattttacttctgtgtgcaaactgagataaaattgtttaaatatttagcattctgtttttattcccatttacctaagtaataagtactgtgtcagaaaatcaagtggaagaggagactggaaataggcaaagaatctgcaacaaaaatcaatatttaataaactttgcattttaagaaaagaatgagtatatgccctttgcagtagatttaactcaaacttatcaatttcagacctgaatttcaatttgctgagcaaactttctctatttggacatgttttcttcttttctggctcagcttcatctctactgatgcctaaaggatttgtgtgagttgggttacatttacaaagcacccagtgtgaaatggcattttattctctgtgcatccaatttttttctattctttttctttgttgttagttggaaattgacaggagtttcacactgtgatgcaggtcatcaaaaatacctatcatggaatacatacatactttctttgattaaaaagtaaattgtagcagaaactggttgtcagcttctgaccatccagatattgtcacgaaatttaaaaaatgaaacagacttaggaaactccatcatcacttaaagtaaaataataaattgtacatggccattcaaatcagtaattctgaaattgatcaaaatctgtctaggtatatatagagtacatatttttaaatggaatgggaaagacagaaaaacaaaaaacaaaaaacagagaagggtggttccttcatgacaagaacaaatgtgaagtgattgttttaaccaagaagtgatagcactactaagcagcttcaagttacatatataatcaactagtaaacattttgttgttaaaaagcattagcttgcattgtagcttttaaaaaatatatataacctgccatgtagcaaaagatcccccctcctcatcccccactctaaatttttatgaaatctgtttcacttgcatttcataaactgagtataaaataaagttgtactgcaaaaaatagcaaatcaagtcaaatgggagctactgagagataaaaagttatgttagatatgatcctcgattaggagtatttataagtcatttgtttcagtctaaggagggatatctaagaacaagtaaatcaattcaaaacagtggggaacttgctctaaattagctatttactatgtgctatagggtcatagaagagagactcaaattcaatctcgtgggagcagaaaagtaagcagtaattgacattaactctttttaattctacttttcaaccctttacaatttatcaagtgatagtgcaatgtgttggtcctctttaactcattcacgcccaggggctcactaacagtgagaggtgtgacatatagaccatctcaaagggttgctagaggaaagagataatgttaagctggtctttgtaactgaaagagtcttgtaattactttcatagataagaatcatttatcatgagctcatttattttttatcagtgatattttcaagcctttaaaagtttgctaaacttcactcttgagtataataaataatttccttgtttacattaccaatttgcttggaaaatggtttctattttacacatcatagaaagtcaattccagttcatactatggttatcatgagctacaaatcagtagtactctaaaatacattgtacttaatgaatgatatgctccttggtatagaaatatttctgcttttacatttgtgttcttctcaccaaatcaatgacacagtatttgagtggatgtatcttctagttgattttgttgttgttgttttgttttgaaagacaaattatcctctattttcatctgacctctgcatatggatgtgtgatatatgtcaggatgactgtacaattctgttataaactgtttctactgtaataagaaaacaatgaaacatactctaacatatcatgccatatttcttcacatattaaaatatttttctcattttaatacttctcaaatcaagattcatcctaaattgctacgtgcactgatgcaattttgcagacaaaatgtacaatcaaggtttatgatatatcttatattaatggaatcttagaattgataacatgcaggattcacaagaatatctgcctataggtgaaaagtcaacatcaactcctgtgacttcctaaagagaaatttatgtatgttctgcattgctgcaatatttcattaatctattttaattacttatgaaactctagaataaatctatttttaaataaactttttttaaatcttagccccaaagtaggtttaaattcagtcatgagaattattcttttccagaatcagtgttttgctccagtgtgtaagcacacaagaattcaaactttacggcaatagaaatagattagatataaagattctttagcatacttcaaataaatcgaagccttgaaacatctaattaaataaaaacagttgaaatttttaaaaaatcagcaaattataaatataccttaggagaatttgattgcctctattgtacaagaatccataatttgtaggaaattgacaaggagacagaataggcagttgcagggtttttgtttgtttggttggttggttggttggttggttgggtttggtttggtttggttttcgagacggagtctcattctgttgcccatgctggagtgcagtggtgcaatgtgggcgcactgcaacctctgcctcccgggctaaagcgattctcctgcctcagcctcccaagtaggtaagattacaggcatacgccaacgtgccccactaatttttgtatttttagtagagacagggtttcaccatgttgcccaggctggtctcgaattcctgatctcatgtgatccacctgccttggcctcccaaagtgctgggattacaggtgtgagccaccgcaccaggacagcagcctcttttatttatttgttgttgctatttacttactgatctcacccgattcattttctaccttaggaagattacagaatctgagactgccagtcgaccaatgatttcaacagttgacatacttctgttagatgaatttgaattgaggaatggtggtgtgagggatgaaagctaagggatcaagattccaagaagcaatgacaagttttaccttgaggaaaggaattcagggtctaactcttcccgcacattttgtgaagacatgaggttcttccaccagctcagaatagaacttcaactatttttctcccttcgttttctgatattaattttacttctctatttttctcctatttttacagtattctcactgtaactcaacattttaacctccatcctttgtggagctaattttagtttattgctataataaaaatgaagacaggagaacttagaatttgatataaactgatatacctattcttttaaggtgaattaatctaagatgttattattaattgattatgtctgtattcctttctccagagctctgaaaccatgccagcctctctgaattttcaaattaaaatacaaaacatagaatctaacagcattacttggatatatttataagctattaaatctttaaaggagaccattagctgcattgtccctataggaatagatgaaatcagaatcttatagtagagttccattcgaaaattctattaatatctcttcctaccttgagtcagatcttatacagctgggattttaaactaaaattttataggtataacttggagaatgattgaaggaagacacttaaaaaaaaaagaataaaactactgcaatccagagtttaaaaaaaaatcaaattcttttctctggcctcatcaagctatgtaaccttaaataattctggctcttggtttctgcatatagtaatgaaggctattatattattaccttctgtatacagaaacataaaaattaatcccttaaaattatattacttatgattaatacactaatttcattttacttttgctagaacatattagttttcaatggattaaatatctaagaatgtggtaatttttactttgttacgttgtgaaagccaatgtctttctctctccatccctctctctgtcttcgtctgtgtgtctctttctctctccctctcctttctctctctcaacctctatatatctgtgtcatatttatttactggaatagaaagtaggcattccaagtaaagcttgagttgataataggtaaatgtctcacaaatacacaagacaaataagttatatttcctcatagaatttcagtactgttagcagtttttattccttcttgatgttaaatttccatttgaaatgagaaagtggcttttctagaactataattaataatcaaaatatttgaggctgtattatatcagtgtcaaaaaataaaaattgttttcagctttccaaaatgatttttgctggcagataagctttttttgttgcaaacttgtgtaagttcactctttgagctgattttttcaatcagtaatgttctgctgattttgtgaaacaagttgttgttatttttggcatttttgtgaaagagcttgaaggaaacaatcatttacatactctactttctatctgataatttctaaagctattagattaagagaataagaaaaaatagcaaaatcaaaaatttatacttattccaactgtcaaaacttatatgcatcatcaaatatcctaatatatttaagaagaaatgaccaagcttttaatcatgccattgtttcttacatattcaaaatgggaaatataccaaatgtcatgcatcctattctatgagtttaattgttatcttccaaaaaactgtttaaattttaaccctatgtacctgtgaagatgaccttacctgaaaataagttctttgtagattttaataaggttaagatgaggtcattagggtgaaccttaatccaatatgacagatgtccttataaaaagagaagagatgcagacacatgagaggagaacgccatatggcaatagagccagagattagaatgctgaagatgcaagtcaaatgatattaccaaatggcagcaaaccaccagtagctgggaagaaggaagagttctcctctacaggtttcaagagcatggtcctgccatcaccttgatttcagacttctagccttcagaactgtgagacaataactttctgttattttaaatcacctagtgtatgatacttgttatggcagccattaggaaattgacagatatctggtctttatcaaaaataaatgtagttttaattctgatttaaattaggtttggtttaaaactgaatataatgatgtccaacacttcacttgaatagtaagttaagaaacgctgttaggcctggtgcagtggctcatgtctggaattccagcactttgggaggccgaagcaggcggatcacctgaggttgggagttcaagaccagcctgaccaacatggagaaacaccatctctactaaaaatacaaaattagccgggcatggtggcgcatgcctgtaatcccagctacaagggaggctgaagcaggagaatcccttgaactgaggaggcagatattgtggtgagctgagattgcactatagcactccagcctgggcaacaagagcaaaactccgtctcaaagaaaaaaaaaaaaaaagaaagaaagaaatgctgttatgttttgattatgggaataaagcctatattatttttaacaaattttttcaatgttctatgtaacaattttaaattaaatacctcttaaaataatatatatagtcattcgttggtatccatgtgatattggttcaaagactccccatgaacaccaaaatctgcaaatgttcaagtcttttatgttaagtggtgcagtacttgcatataatctatgcatatcctcctctatacttacgtttatcactagattatttagaatacctaatacaatataaattatatgtaaatagtttctatgctgtattattacatttgtaatttttcttgttgtattgttatcttttattgttgttgttttttaatattttcaatctgtgatttgttgaatccagggatgcgatatcagtggatatggaggggtgactgcacttacttacttttatataaagttgttcacattcaccctttacccatctttaaaagaaattgttttactttcagatgtacattatatctttaatgtatatctctcctctatcgaggaagatggaaagatacatattgcaagaaaggttgaattcatattgattaggtaagaaagtctaatttccaaattagaacttgataaaagaatacaattagagattataatcactttgagaaaaagatctggcagtgtcctataaacctcaagattcacctcttatgaccctacagttccactcctaggaaattactcaagagaaacagaaacataggtctacacacacttatcaagaaagttaatagcagatttaagcaaaataggcaaaaactgaaatcttcctaaattgtcatcatcagaatggataaacaatgtgtatataataaaaaactgtttagcaataaaaatgaagtaattattgatatatacaataacatggattagtctcatataaaccatgctaaatgaaggaagtcttacacaaaagaatacatgtagtatactttcattgataggaatttctaaaagagacaaaattaataaaaatattgattacctctggggttgggtggtgaagtgtttgacagtaaaaaaagtatgaaggtatgaaggtttttcctttgtgatgataaagcatgttttgtaccttgacaggtgttggattgaacaggcatatgcaattgtcaaaattaatgtaataatatgcctaggatttgtgcattttattctgtggaagtttaattgtaaagtgaattgtaaacaaataatgacctttacatatatacatgctaaggtatgtaggggaacagtgcagcgattctacaaatatttttgaaatgtagaaaataataagatgattgaactatagacagataaagggatacgtgataaagaaagtatagtacaatgtagcaaaatataaattaggtacattgtaatattagtgagtataagggtattatgaaattctatttttcagtatgtttgaaaattttcataacaaaatgttgaaaaattttaataagaaaaacttacacacacatatgcagaaatcatttttagaatgatttttctagtagattcaatgaaaaatgtcacttctatgtccagaattcttcaatcatattgatccagagccattcatgataattctttaaaatagagatactctttgaattcaaaacaggtaactgtcagttaagatagtttgcttattaaaaggttctgctaaatgtctgtatttattataataactgtattagatttgtctcataataattatgagaaattatctttatagtgttgtggcaaatgtatacttattaactagcagcattggcatgaattacataaaataaactatttatttctacattgctacattgtttataatcttattttaatcttacttaatacatgttttatatagtggatttaaaataaatgtttgtggaagaaaaggatggagagatgcattccatttaaagtgataataagaattattactatctagccatgagctggaactaatcaaaagggtctacttagatgcaaatggggtggagaaatgctgtctatgctcgggcaactgcttttcagcaacaattttatattaaatagaggaaggtcacagttttctgtagaaaattagacatcttgcccacatttattttgttttgaaatattttaaaggcagtatttttcaggggcttgtttgagtacaatttctttcttttattttatttatttattttttttgagacgttgtctagctctgtcgcccaggctggagtgcagtggcgcgatctcggctcgctgcaagctccacctcccgggttcacgccattctcctgcctcagcctccagagctgctgggactacaggcgcccgccactacgtccggctaaattttttgtatttttagtagagacagggtttcaccgtgttagccaggatggtctcgatttcctgacctcgtgatccgcccgtctcggcctcccaaagtgctgggattacaggcgtgagccaccgcgcccgaccatttgggtacaatttttttgtattatttttgtacaatttttatatttgtattatttgtatatttttgtgttatgttgtattatttgtattatttagatgtacaatgtttgatatctaaggacgtatttgaaaacatcaattatgtttatgtacatacatttgcacacacagacatgtataatgtatatacaggacttttgaacatctttcctaatgaaatatcttaaaaaatttgatgcatttattgaatattttgttcctttagaaaagaatttccaaatacctattttgtttcaagtgcctgttagagagaaaaatacaaataaaacagcaacactattcctgctgtgctgagagtttttatatcagtttctttacaaatacagatttctgaaaggtttgaatttacacaaatctcttaaggcttattaccaataacaaatccaaattctctttcactcaaaagagatctgagggaaagaaaaataaaaggatgttttcttctgcaaaggaaaaaaaaatagggatttaggcatttatttgattgtttgttgtttcacgaaaagcttgattggttgcttggtcatgttacagcctaatagtgatggtaataatttcagtaaatagatttttaaaatggcaaaatacacaaaaactgagaaggaaagttaatacaaagaaagccattctttcttgcttcaatcaaatacagaagtccccagtagataatcatatttttcctgtagttatatttagtatgaacccactatggttgagacactgtgttaagtattttatatacattatttcacttgatgtttacaaaaatttttgatgtcagattgtgatctctgttctatagattttttaaaaaagaagattttgggagaagggacttgtctgaagtcaccagtgaaagtttgaactgattatctgtaaccagagagctatattttttgaagagactatttagtgttaatatttaacttaataaaaagaaaagtaaaatctcatctttattaatacccattctgcttccataataatgataaggtctgattctatcaaaaaattctcattttatcagttgctaacatggtattcagatgattaccactgtcccagtcttctggtctttaacttgcttgctgattcagaacaaaatcaaataagtattttggcctttctttataaagccctaaatgttgtggatcttctgataaatgcataattgagcaaaaacctggacgcaagcaagtgtattcagcttaccaccaccaaaaaacttagttgccaaatacaagtgccctagtccattttgtgttgctatgaaagaataccatagactgggtaatgtactgtaaagaaaataagtttatttttcatagtctggagactgtgcagtccactatcaaagtgcaggcatctggcttgggccttcttgctgcatcataacatagtggagggaaagaaggtgaggacggggggcaaactcatcctttaatcaggaagccactccaggaataactaaccactccaaggtaacagcctaaattcatgcgggctctgccctcatgacttaatcattttctaaaggtttcatctatctacactattgcattgagaattaagtgtccaaacatgaattttgggggatacatgcaaaccattgcaacaggttagtaaaagcaaaatatagatttttctaaattgttggtggcaatattataaacttcctctgaaacaataaaacctaggggaaagcatattaataaatggctgtgttgcttatcttatttctctgatgacctccttattcatgaatatattgtccagactccaacagattttatctcgagtccaaaattttaaaaataatttatctctcttgcacagtgtgcactaaaaataatttataaaatagggaagtgtataatctgtattggtaggagaaggagaaggaggaaagaaagatacgataaagcaacaaaaagaagactttattaatagagtactagaagaccctattaaaaaaataaataatagaaaaagaacaggaagaataaaagtgacagtatgaagtagagaaaccagtgagctaagggcaagatgagggaggagtcaaagtgttaagctagggtctcaaactcaattttttttttttttgcctgaggtcaggcaggtaatgtgaatgagtaaattgggctgattgtaagaagaatgtggccagtgtttcatttctttttattttgtttttaaatcagctttctttccttgcatttgataggggaataaacatttctttttgaaataaacaatagtaaaagtgaaatgatcaaaggtagtgttctcagtctctggaaaacaacaaagaatggtatggcaaaccagcattcatactggccctggaagagggccggtggtaggcaccattcagctttgtccagtattgatagtattttttaatcagaagctgaaatctaaattttaagagaaatctgaaatactgacaactcattaaaaaaaagtttaagttaatgtgaatactctcatagcccttactgactccattcctacaggttggggattgtggcctatggctaccagactgcatgcttactattaaaaagttaagcaggccgggcacagtggctcatggctataatctcagcactttcaggggctaaggcgggcagattgcttgaggtcaggagttcgaaaccagcctggccaacatggtgaatccctgtctcggctaaaaatacaaaaaaattagccaggtatggtggcatgcacctgtaatcccagctactcgggaggctgaggcaggggaattgcttgaaccagggaggtggaggttgcagtgagccgagatcgcaccaccgcactccagcctgtgcgacacaatgagacttcgtctcaaaaaacaaacaaacaaaaaaacaaacaaattaagcggaagggaataaaatgatatcctaactttacctctagctattctcaaggcccgatgggtcctgctgcttactctgctcttctccagatgacttttctatatgtgagactagcacaaagctctccattagttacagtcatgcatcacgtaacaatagtggtgtgttctgagaaatgtgtccttaggtggcttcgtcacggtgcaaacatcctatagtgtacctacacaaacctaaatggtgtagcctactacacacctaggctatatgggatagcctattgatgcttggctacaaacctgtatggcattttaccgtactaactctataggcaattataacacagtgttaagtatttgtgtacctaaatgcatctgacatagaaaaggtacagtaaagataaagtataatcttacggggtcaccggtgcatatgcggtctgtcgctgactgaaacataatgcagtgcataacagtatttgatttttaaaagggttttaggatttttgctttggtctaaactaatttttttaataagagccacacagtgttcaattctggcttatttgttgtcatctattttctgagatcaagtctattccaaggaataggtcctgcacacagagctggcttcatgggtatggcatcactggaattgcaaagggttctgcactcagaaagaagccccgtgtttagggtttaatacaactctgtgaatgttgtctttaaattattactaattttatgcttctgtgtgttttagaaggtttgatgggacatggatcaggagctggggcttagagtctttgtccacaggttgtcctgcctccttctgacctccaccatctccccacttccccatcttgggttcttggttggcaatgccccactcctgtacagataccactggcactctccactccagcaagggcctggacacaggtgttaggagagttagggtatgcatatacattacagggaccaagtcatggggctttgcccaaggcacctatgaggccccatgattgaggggtcacaatattaaatagaaaataaaaaacaccacagcaattcaagaaagaccacagaagaaaaaaaaaaggtgggttttgttttgttttgttgtttcgctttttgcacaatgtgtcctgcattttcattttatactggattctcaaaataacatagctggtcctgcttctcagggtattttatcactgcttacctactctttcccttgcacttcacaaacctcttctttgcctaaaacatgcaacatcaaaataaatggtccagcaaaacctgaaggtgctttaaaatgtagttaaaagaaacaggaggcaattctatttagaagccgcattacactctaccccaaatctggaaagtgtgaagagaaaatgccagcataatagctatcactctttgttgttaacacagctgcttgctcactttagttttctcgcacatataaggcagagctgtgatgtactcagacagatcacattcaaattctcattctgccacttgctaagtgatgaccttgggcaagttactcaaccttccttagccagcttcgctcttataaaacggttttaataatgaatgttcttgcagtgttgttcaggttgaatggtgtaagatgaaacaaatttgtagcataatgcctagcatataatacaagttctttcattcttatgaaaacctatatatatataatgtaaataatattttatatttttagtattttaatgcacacaggtttaactcctttttgtgtcagagaaaaacaaacctttcattttagctgaaatgattagaagtcatcatatagcatttataaggctatggctactgagtctgcattggcccatcaactgtcattgtagggaagagatgagtgggctgagtgccctgcagtagcaagcttaatttatggcttttggaagaactgagccccaagcataatattcaaggtctttaatatatcaaaaggctttttttcttagataacaaaaatttcctctggttttttgatatgtgaaattttagtgtgcataaaatggagctctatattagcccactctgcatgttttaatagtgttacagtggtggctaatgtctatgataatcaacagttagcaaaaacatgaatttggatattttcacatttattatacaaaaagacagtattttttttaaacggtattgttttaaacagcagtttaaaacacaataaaattaaattccaaataagccataatttttatcagggtacttttaagtaatctgtgtgaaatcattgagggtactcacagatgatgcaactaatttattcagtcttaaaatgaaaactcacaatgcaggtaagagatatggagaaacaatttttgcagacacaaatttaacttgtattaaaattttattatcctcttttcaaaatcatgaaatcagcatatttagccgtaagtaactcatatgctgattactaaaaaatagtgtcgaagtcagttgatcagtgaagtctatgcatccattaaaagcatagctagctattgattaatggaaatcagcaaagacctataaggcagttaactaaaagcagaaaaaaacacattcctacaagtgagaaaagccaggagaaaaattttaattactctctcacgaactcataaaaacaaagaaacaaatatgcaatcaatagaaaacagttgtttttctgtgactaggttaactaaattacgtcttagcaaaggagctaatatgataaaataactaaggtctaattaccaagataattagaaatatttgtttggctggtgacaaatattagtattaaataccgaaagcttatgaatatctaaaaacattttccaaatgatctacaatgtctatagaaagagaattagcatcatgaaatgagatgcacaaatgtgaaacaatcttaaatcattgctgaaactatagggacctaagtagtagttggaattaattcccattgaagtaactaaatgaattacttctgcttcaatgaattaaactgaaatatatttgctctaatttacatttgtgctgttttgttctgtatcaatggaaatggataagtgtttcctatatttattatttcaggagcacaataagctccctgtcagctttctcaaatatcgtttttcatcttttggccccattcactctccatcttcttatagaggttacttaaaagcttagcacaatgtaatgaagtttgtaggatgctttatcatcacagaattgatttgataaaaatagagagatggaggagagagaaggataagagataggctgggcgcggtggctcacacctgtaatcccagcattttgggaggcccaggtgggcagatcacgaggtcaagagatcgagaccatcctagccaacatggtgaactggaataagacaagtatgctcactctgaacactcctattcaacataccactggaagtcctagcccaggcaatcaggcaagagaaaaaagtaaaagtcatccaaataggaaaagaagtcaaactatctctatttgctgtcaatatgattctatacctagaaaacactaaagaccctatcaaaagacttttagaaatgacgaaggacttcagtaaagttttaggatacaaagtcaatgtacaataatcagtggcatttctgccaataatcagtagcatttcaggcaaaaaccagtagcagattctgccaatagcatttccccaacaacattcaagttgaaagccaaaccaagaacacaatccaatttacagtaacccctaacattaaaatacgtaagaatacaattatctaagtaggtgaaagatctctacatggagcactacaaaacactgctgaaagaaatcacaggttgcttaaacaaatggaaaaacattccatgctcataaattggaagaatcagtattgttaaagtggccatactgcccaaaggaatctacagacacaacactatacccatcaaactgccaatgtcattttttacagaattagaaaaagttattctaaaattcatatagaactgaaaaaaaacaagcctgaatagccaagaaaaccttaaaaaaaacaaataaaaaacagaacaaagctagaggactcacattatactacttcaaactatactataatgccacagtatcaaaaacagcatgatactggtgcaaaaatagacacatagaccaacgaaacagaatggagaaccagaaataaagccacacacctgcaataatctggtctttgacaaagttaaaaaaaataataataaatgggaaagcactcctgattaaataaatggtacttggatagctggctagccatgtgcagaagaatgaaactggacacatacctctctccacatacaaaaaataactcaagatggaataaatatttaaatgttaagacctcagagtatcagaatcctagaagaaggccgggcgcggtggctcacgcctgtaatgccagcactttgggaggccgaggcgggtggatcacgaggtaaggagatcgagatcatcctggctaacacggtgaaaccccgtctctactaaaaatataaaaaaaaaattagccgggcgtggtggcgggcgcctgtagtcccagcagctctggaggctgaggcaggagaatggcatgaacccgggaggcggagcttgcagtgagccgagatcgcgcccctgcactccagcctgggggacagggcgagactccgtttcaaagtaaaaagaaaaaagaaaaataaagaatcctacaagaaaacctaggaaacaacattttggacatcagtctcgggaaataatttatgataaaatcctcaaaagcaatgtagcaaaaacgaaaattgacaagattgacaagtggtacctcattaaactaaagagactctgcacagcaaaagaaacgattaacagagtacacagataatgtaaagaatgagggaaaatatttacaaactatgcatccaacaaaggtttaatatccagatctatgagtaagttaaacaattcaacaagcagaaagcaaataattccattaaaaagtggccagaagacatgaatggaaatttttcaaaagaataaatacaagcagcaaaaaaaaaaaaaaaaaaaaaaaaaaaatggaaaaacgatccacatcactaatcatcacagaaatgcaaaacaataccacaatgagagacaccatctcatcagtcagaatggccatcactaaaatgtcaaagaaacagcaatgctggtgaggctgcagaggaaagggaatgcttatacactgttggtggggatgtaaattaatttagtcactatggaaagcagtttaatgatttctcaaagatcataaaacagaactaccattcagcacagcaatccaattactggctatatatccaaaagaaaataaattgttttactaaaaggaaacatgcattcatatgttcatcacagcactcttcacaatagcaaggcatggaatcaacctaggtgcccatcaacagtgaactgaataaagaaaatgtggtacacatacaccatgggacactaggcagccataggaaagaatgagatcatgttctttgcagcaacatagatgcagctgaaggccattatcctcagataattaatgcaggtacaaaacaaaacaaaaaaacaagttataagtgaaagataaatattgagtaccaatggaattaaagatggcaacaatagacactggggactattggtggggagggatgaagaaataggggaagggtgggaaaactaactcttggggactatgctcactagctgggtgatggaatcaatcataccataaacctcaacatcacacaatatacccatgtaacaagcctgcctacgtaccactcattctaaaataaacattgaaattatattataaaaaagtgataagccctaagccaaaaaagtaatgaaatgaagcaaaaagttttaactgaaatatttaaaaattagtgcaatgtttaaagcaaaatcaaaaaggaatcaaggaaagaagaaaggacagaaaaaagaagggacaaaagaaggaaggaaggaaggaaggaaaccctagaaaaacataagtatacaagaagaaaaatataatagtaattggctctatttgaacaaatttacataaggctaatattttatactttcaacttttatagtcaatctattcacaaaagatggaagacagtatagtttcagaagaatgcctgaatattattaacaaaaaagagcaaaaacattactacagatggcagaggctgtgtgttagaagggaagagagaggtgaaggaagataggagatataattttaaagaggaaagtcaaaaaataatatcattagttgaagaaataagaaatgcaggtttgtattaaaaatagggatatacatttctgggatgtgtaaacatttctggtaagagaaaggcaggtattctctaaaaactgataaataaattagactcaacaatattaacacattgttgagacatttatatgtgtcagaaaaaaatataaaaatacacaggtttaaagaagtaatgtgttcttttgagtatgacattgagagtaggaaggatgtgtgactgggatggtagttttgactttgggcttattttatgtagataacaaagcaaacctctactcttttgagaagttaggatatttagtctgagaagtttgagtgtggagtatgaggcaactttggctaaaaatatagaaggttttctaataaataacactggaatgaaccatcttgtaaagaagtgaattaataagatatttcaggaaagtttcatgtatataagagacattacattcgaggttctatggtctaacgtgcctttagcggaaggattttcaaagaactgctactagatggcaaactcaagttattttttaaatatgatattttaactgaatttttgcaataagaaatctcatagttatccttttccttctccatgtttatcttatgttaaaagaattcagcttttagaaataaagcaacaaatttaacttaactcaaggcaaaataaggccttatattaaattttcattgaagataattttgatgaaaacctctcagagaaatcaaaggaaaaagaagctggaagtacataaacaaattataaagtagaaattggttctgtgaggagagatttatttggtttaattttctttgggtaatataaaatatataatctattttatgaatttttttgtcatttttcatattaggtttgaattcatacctgaaagaactagatgaatgttactatttcttttgagcctgaaatttctttccaacacgcctcacattattgaaacattaatactaagcagtactgtctacacctgaaggagcagccatcacagagctgggtgataaatcactgctccctgatgtctggcaatgtccaaaatgcaagccagttctctggaagtgttggtgctggcacctgccatcccacttcactcttcacaattgttggaacagccttcttcatactgagcccaattctagaccacataaataaagtatacggcttttccttaaaatattatgtctttttttgtagggtgaatattttttgtaccttaaacttactgtatagttggcttccagatctaagtcatgaacaaaaaagtcctgactatattatactatgttgtatgatgttgttttaattatattatagtattatatttatcatattatatgtaaagtaaaatatatcccttctcagtattcacccaaccatcccaacggcacatctttaagtggcacaaactttcactgtttaattatttaggatcatcccaggtttgttattaatggtttttaggctgctgttctttatcactctcaagaggtgagacttccagttttatctctgacttttacctctatggtcttatacctcagtcattaagtgttagtgatcaagacatgtttttaaagtctatgctttttcccactcttctcattttgcctgggatttcaacatctatcacccaagctctatttcttaagatgtgacaaacacctaactacccttctacaagactcagggaaaatgtttcctgtgagaacacattttctgacagaccacagataactacctactcctttctactcctactgaagcccataatcatatctatgaaggaagaacttattacaagggactcctagatgacttcctatgtcctctatacaccaaatcatgcataatttcataatctcttcccattacttttaggataaaattctaaagatttaacacatttagcacgaaatataaggctcttcatgatgtgatctcagactgcttctttagatgtactgataccccacatacatgcataagaaatctctctcatgtcaccccagcaacccatcccatttccacgtagtccatcaaagaagcagtgaataattccttcatgtcattcagatctaagtttaaataccttactatatttattggggcatttattaactcctgaataaaatggtctacccaatcactcatatcccagttttatatcacttagcatttatttctgtcaagaatggtaatacttgtttgcttttctctcttcttccattaaaaagcaagtggaatgacactaggatgttgtctctatttctgctgaattcctaacacttaaaatgttggttatatttttttaagtaagtgaatgtatgaatgctggctttgtgagaaatgaaatgtttcttgtcaagttacctaggaaatattatattagcatcttgcatttcccccttttcacatcaagtatctgaaagttgaaaggggctgaattattacctctcccaaagtgcccaatattttaggattcaataaatgataaaatttttttaaagtccataatttgaaaagaagaaatgaaattttaattctcataaattagtaagaaaataaattcacgatgtactgagtgaatttagttttacagagaaccagttccgtggttcttattgtttttcttttggaatactgtaaacttcaaggaaggacagactgatatctgcagttctgccctgggagcctctgacccagcccatacttcctgacactacaagatctccctcaccacgtcttcttctaaatccacttctcttgtatttctttttttactctcagcttggtaaaggaaactaatctgataatcctgtctgagaaaaaaatattgatatctgataatggcttaattcatcttttacaaaggtttgcaacagccagtaacccaaaggaatgaataaacaatttaatgttttgattgtaatttccagtagggaaggtgttaactttcttccagctccttgagttaaactacataaaaagatgttctgcataaaggtggtctagattaccaaagagtggcattttcttttcatactattagtttattaagacttaatatttttcatggtaaaaatagtaatagtaataacaataatagtaagaactgaaatttattgagaatttgccatgtaccaaaaactgtgccaaatgcttttcaaacagtatctcatttcatggtcatagatgtactatagaaaatcacttttatcccaaatttacaggtataaaattaggcttcaacaggttaaatctcactgctgatcagtggcagggctgggatttatattatgatctgtataattccaaaaatcatgattttctacagcctctcaaaaaaacccatatggttttacaactgggttatgatttatctgtcattaagccctaggcatgaatcccttactaatagccttgagtggtgacaaaaccttttctttctgaaaatgaaaaactaaatgacatcataaagtagcaacttacatttttatccagctctaatcgttaccacatcatttttcttaatggatcaaaatctaccaactatataatttgcactatttaatcccattcttgctcctaaacaattaagataggaaaaaatcaaaaatgtaccctaaaaaacttctaatttcatattctaaagatgtatggaaatcttttaatagaaaaaaactagataaatcttaaaaccatttttatacatttttaaagtcactatacctttttaaaattaagggtcttaaagtatcaatctttcaaactttcaattttattacccaacattctctaaaatctatgtgtgaaaaattattttaaaaatttgacaattaagagaaaaaagacatgatgtgagaattcttaagataaaagaccacttcagttacattagcaaatattttgatttaacatgtcttctaaaatgtagcattcatatccttgtatttctatctctattttgatttaatttaagttatgccataaaatagatcatttacacttggatgaagatatcagaaacttcttttattttccagaccaaatgaaacttttcagttgatttctactgagcttcagggagtattttgatagtttgggatttatttattgttttaattttaagagctaatgagtaaactaagacacaccattgaaaacaatactagctgaatgcttttaaaatgctgaaaatggccgccagaaaatatatttattcaaatgccactatgttcttttttaaaaatgtcctcaagttatacttttttaaaaatcagagacctgtgagataccatctcacaccagttagaatggcgatcattaacaagtcaggaaacaacaggtgctggagaagatgtggagaaataggaacacttttacactgttggtgggactgtaaactagttcaaccactgtggaagacagtgtggagattcctcagggatctagaactagaaataccatttgacccaggcatcccattactgggtatatacccaaaggattacaaatcatactgctataaagacaaatgcacacgtatgtttattgtggcactattcacaatagcaaagacttggaaccaacccaaatgtccatcaatgatagactggattaagaaaatatggcacatatacaccatggaatactatgcagccataaaaaaggatgagttcatgtcctttacagggacatggatgaagatggaaaccatcattctgagcaaactatcacaaggacagaaaaccaaacaccgcatgttttcactcataggtgggaattgaacaataagaacagatggacacagggtggggaacatcacacactggggcctgtcgtggggtggggggaggggggagggagagcattaggagatatacctaatgtaaatgacgagttaaggggtgcagcccaccaacatggcacatgtatacatatgtaacaaacctgcacgttgtgcacatgtaccctagaacttaaagtaaaaaaaaaaaatcagagaactgcttaaatggttcattctaaaccattggtttagctattgaactaactttggttgctattacatttttagacatataatcttaacagattataagtttctttcttttgtttctttccttatttttctaagaggatgaagccaattcagtattatatttattgtttagaaaaaaatgaatttagaggtttcttaattttttttatttttatttttatttatttaaggcatctgctggtagagctgtcattgctcttactttgttataattcattgaaaatggtcaacgggaagggcaatttagttgctttgacttgcaaacagaatattttccctaaatattaccttctagcatttttacaagtccaataacgtgttcatatatgagtcatagagcatatatttttagattgcaaaattatactagcatgagacaaggtactttagatttggattgtgaaaatatcagttttaaatttatagtaatacttgcttcagtttctgtatacattgtcaagtttattgcaggaaatgcggaagagttaattttatattttattcattattcaaataattattaagatgtttataaactcatcacaagcattgctcatttttattggcttgcaatcagcacttaaaatcctattgtaaaactctgcaacacatgaggtttgacagataatataagtttacaggaatttgaaagatctcacaaagcccacagaaatattttcttggaagtttttttttttttaatgttaactatacaatgctgtttagtgatatactcctgctggaaaaacaatttataatttttatatttctcattgcaatcctaaataaatacatatattattcaagttttctataaaaattaagtgtttagttaatatcacatgtatctctctaaagttacatgaattcagagtaaattattataatcatccatattttaatattcaacttgctttttgtatcagtggttaatttggtaaagttttaatatatttcatctttatttcctaaaataatattaaagggatggtaatatgaaaaaaaccacaatatttatttaggatcgtaaaataagatatttttcaatatgcagaaggcaaagaaaaacactaagtatgtaaaaagataataatacagttaatttaatttaaggaaaatataatatccaaatctcataggtgttctgtttcaaataatcacttaacagaaattcacagcagcaaaacaatataactaccgtagtaaatacatacatatatataaatagacgaaatacacaatatatcttatttttgtatatttactaatcaaaattattttaaaataactttatagcttcatgcttcatgccttctcattgaaacattttccgataaaattgttgatgcttccgacaattcctattatcgcaatttgatatttaaatcaagaactacctaaagctactaaatctttgccactagcctaaatgaggcaatattcttctattcccatgaattattcaagtttataaaatggtgaaatcagatgacaaaatattgtattttaatatggactatgtattcttatataagctattacgaatcaaaagaaaactggaagtaaaaatgaaacttcaattagttttattttttctttacattgattaccggaagcataatttctttatttttaattaaattcagcaatgtaaattaagtatactgtcacaaattcatttatcttcactagtaaaatctccacagttaaaaacaaatagcaatttcttattctatggttatgtattgcccctttcttttagttatctatcttacaaatttaggcagattctcatgggtggtaaaagagtggtagatagcactgtttaatacatcctcattaaaagcaaatatgtattatgttgtattagtgaccacaaatgagcttgattttatttcatgttttgtatacataatttccatattcttacattcttttaattctttttgtgcattttggttacttattaattaaatatattctacattaattttattttattttgtttgattttgatatatttattattgcttttaatttaatttagtagtagattatattgctaaacatgtgagttaaatccaggagtaattagagcatatttcatatgtgtcactttattaagtgtaaatttgaaagggaaaatatataaataacattaattgtaccatttagaatattctaattttgtattagcaggtaaagcaatgagaatatatacgctttgacaactaatccatagagaaacgagagttgttttttttttctgcttgtgcaaagcaaattagaaaaacaatcaatatttcttttccagaaacatttgctctctgccccagatttatgttggaatgtttatttggtttgtatgactctcaagagatgtggcttaatggaagtacttggataacagtcttagaaatctaatgacaattgtttgtttttcccaaataaccacttcctaatgattattattgagccttgcagtgttaaaatgacatgtttagtttcagatgagcatttaaaaattatttcagctattctgttacttggtataaaataaatgtcaattttttgacctattgtagatgttcagaagcagtcaattgttttaatataaatgttgcattcttcacttatgcttcacacatggatgaacaacaatttgaagctactagatcaattctatatatgttatttgcagtaagtatacattcaagtacagatatttatttttttagattggattgtctcttaatataatttaattcacagtaactaccaatactgaggattatgaaaagttttgtcctccatgtaaacatgtattgatatttttccagatttttccacattaagttctcattaatcattgtatattccagcagcatatcaaaaaattaggaatttatttagaacttagtagagctacactatgtagagtgaaaaacaaaacaaaaccttaccccaattcacaaataagtgtacaatataatattggcacatttctaattttgcaatcaaaaaggattacagttcaatcctgacttgactactttgttctgtgcatgagcaaatccaaagatctctatagcttattatctgtaaggtgggtaaaagagatgtagcattaaaacaattaaaatagtgcttgaggctgggcacagtggctcacacctgtaatccctgcattttgggaggtcaaggcaggtggattgcttgagcccaggagttcaagaccagcctgggcaatatgtcaaagccctatctctacaaaaaatacaaaaattagcctggtctgctggtgcagcctgtattctcagctacccaggaggctgaagcgggagggtcacctgagcccaggaggtcgaggctgcaatgagcagtgatcataccactgcactcttgcctgggcaacagactgagaccctgtctccaaaaagaaaaaaaaaaataataatgcttgacacagggttccctatacagtcatttttattctatttattttattacattcttcatgtcaaaatggcaaggttaatattgcttgggctttgaagttaagaccatcttgactctgctaactatgtaactgtgagcaaattatattactgatctgagcttgcctattatttagaataagaataatattttattttacataatattattggaggattatgtgagataaaataaatatatttttatattaagcggccaacaaatatttattttttaccctgtcactcagctgaagagaaaaaatatgagatctaatgtacagcttggtgactatagttaataatgtagtgtatacttaaaatttgctaagagggtagatctgcagtattctcatcacacacacacacacacacacacacacacacacacacggtaattatgtaaggtgatttatatgttaattagcttgattgtattgttcatttcacaatgtatacctatattaaaacatcacagtgtacacgattaatttatacaattttatttatctattatacctcagtaaaggtgaaaaaagaaaaaaatgaattacaaagagaaataaagcattataagacttaaatctactaggctttttaataaaatggtaatatttttattccagaaaaggtagatgaaattgttgaagagtaaataactagtttagattctaaatacatgtggatcatattttatgtcacaaaagggaaattttgtgtttgtaaaacaaatatatctaatcacttataaaatcaagaaaacccacttgagcctttacatttgtcagtgtgtatcgtaccattttctatttcatacaaaataaaacagtgtgaacaatcagaaatgaaagcagttaataaataattaaaggcaaaatattttaactaaaaaaagtcactttaaaggagccttacttcactctttaaacaataataacaaaaataagacaataagctagttaagaaggatgattcagacaattgtcaatttgtattttgatgtcaggaagccttttatattactgcttcaaatagcaggacacttgtcagatggctcatccaccctttctaaaacttttccctacaatgactaaactatatctttataattagttatgtatgtactcaagataatagacatgtaaggactaatgcaaaacaaactataaaatatgcatttaccattatcttattatcctatttttcatttatctgtctttttactttgtttcccaggaactgccctcatttatctcccagcactatattatagtcctgtgacaagccatattgaagctgaggcaaaaggaaaaatcagtaatattgatcttgtctttgttttaaaatttattttgttaattttggattttttaatttttttattttcattgtattatattaaaatattatttatttagattgctgagttgattgatgcatactcaaactttcactcaaagtgagtgcctcacttgcttcagcctagtcaccaccctgctaacttttgcttggtttgtactctttcttaaagctgtgtaaacctggtgttctttgaaaacttgtggttcatgagtttgcttgttaatgcaaaccaagaacatcacatctactgtagtggaattgaaattatataaatcaaatttgtttaagtggaaaaaattgaagaaaattgaggtaaaaagaaaataaaatttcaaaattgatgaaaactctgacttaatatatttaaagatacacaatgatattgttaccaagaaggaaattccacctacaaaaaaaattgaatatgcagagaactgacaggagttcttggttttcaatcaatctgtttctttgttttctccactctactccatctttcataatttgcacaaaaggtatctttgctgcaagttcctgagactgaggaattccatagcatgggatcaatgatattatttatctttccccactgacagcttaaggtttattttttttcaaacgtttattatttacctctagtccagaaacttcccagatagcaaaatgttgttgcattgttctagacctccaacctcccattttcaaagtttgtgtcttgaaatgaaaacaaaacactctttagtgtcattttattggagctcaaggatgggaagtagatgtaagtgttcaatgtgccacctttacattaaatttagctttataaatgtttaatgtaccattatatgtaccaataccaataatgtaccattagtaacattaatataccattaattaatggtatatgtgaaaaacctacactgacatatttatgagagaaaacactgaacatgtttctaaactttgagaatacaagaagcaaatcaattattaccactgtgattcaacattgtaatagaagtcccagccagtgaaatagggtaagaaagaaataaaaatgcaaatgttggaatggaagtcttgattatcagataacactagtatgtctatagaaaagtctatggaatcgacaataacagtaatagaatacttgaatttgtaagtaaatttagcaaagtcataggattcaaggtcagtataaaaattaattgtatttctatacagcaacaatagaaaataaaaatattaaaatattaccatttataatagcaccaagaaacatcaagtgggaataattgtaacaaaatttgtgagattcatattatgaagactacaaattgcttcaacgagaaataatataagacaaattaaatataaagacaaatatcatcttcacaaacgagaagactcaatgtttctttagatcttaattatctttgatttgttagctttaatgcatttttaatcaaaatgttacaagaagttaaaacaactcataagctgactttaaaataaaatagaaagggccaggtgtggtggctcacacctgtaatctcagcactttgggaagccaaggtgggcatatcacgaggtcaggagttcaagactagcctggccaacatggtaaaacttcatctctactaaaaatacaaaaatcaggtggtgtggtggtgggtgcctgtaatcccagctacttgggaagctaaggcaggagaatgacttgaacccagggggcagaggttgcagtgagccaagaccatgccattgcactccagcctgggcaacagagcaagactccatttcaataaataaataaataaataaataaataaataaataaataaataaaatagaacaagatgtagaatggtaaaaataatcttgaaaataaacacacttgttagagttacataaccttgttccaaaacttgctctaatgcaacaaaaataatagaaaaatttggccgggcgtggtggctcacgcctgtaatcccagcactttgggatttactttctatgtttctaagataagggctggttcagtggacatagttacatatcagcagaatcccaactccttaaactagtattaatctttcacaaatcttgtcctgatctactttaatatgtaacttttatccatagcagctgtcaaacataatattttctatcctcttacatttagctgacatgcctgccaaaataagcaactaattcttactaaacaccttcttcatacctttcctgattccatttcctatgccaagaatccctcagttttcttcaaagcctaggttcaaatcaacatctgcaatgtacttttgctgcttccctcagctgaaaatgatgtctcattcgtcttaatactataaactttataatatactttcatattaagtaatacttaatacttcttaatggatattgacattttcaacttacactttatagttaaagctctactgtattttaaagtgtatattaaatttccccactgtgtatcatttccatggtgttagagttaaaaatttacaatggtaaatcccctgcagatctctgcacagtttcatacatagttaaccctcaacaaatgcttgtaaaataaatgaatggatgcttttaataatcataggtgtttgtgtgtttctttaaactatttcaaaagatatccacagaaaatttcataatttattctagacaatactagttatgtattccatgtcataggacacaggaaatgctacctacaaatatagacttattgtagactgagtattttaagctgaaggaaattaagaaaaccatagaagcagaaagatctctctgaccttctcctgtcccctcttttgaggaccctaatgtgatatgcacttactcatatctatagggtaggaatgttacacaaagaggccaaaaagaatctgaacaaacaggccttgccaagttactccccagtttattgccattagtacgtatcatttttatcaaattattcttttacataactgtccattcttcattccaccccatggataaaaatacatttttcaccatttctctgggactttattgctgaaggctcctgtgtcatgtaaaactttgaataaataaatttgttatacttttctcttgttaatctgtcaaggagtgccagccagaaatcttgagaccaatgagaaaaatatattggcatacatatggcatttaatatctaataagtttttagtagcttttgttgtctactgaggtgtgatgcttactgaattctctatttatttacaaagtctatctgtaaatattttgttaaataaaccagtgattacataacttttggatctgtgtgatagtcttatttatagaattatctggttttcattatctgatttcattcagtcaacaaaatgttttgattacttattatattacaggcactatgctaggcactgtatatagtgtttaagttttgtgggagagatacacaaataaacaataaacaattatacttattatggcaagtgtcatgaagtaaaagaagtctatgagagataatggctagattgaaatgttacaaaaggtctttccaaagagatcttcaaactacttcagcagagtctgagaaatagggagctatcatatagcaattattatccctatacatgtatatatatgttagcagtggtgaatccatgtgggtctgcagcaacctcaactctggtcttcttagaagaaagaattcgacctggggcaaaaggcagagtgagaggccaaggcaagttttagagcaggggtgaaagttaattaaaagttataagaaggaagggcatgaatgaaaggaagtaaagtatacttggaagagggccaagcaggcaacttgagagattcaagtgtgaagcttgagctttgacttggcattttgtacattggcatgcttccaagcggttgcatcccttctcccttgattcttcccttggggtgggctgtctgcctgcacagtggcctgctagcacttgggaggggttgcatgagcagtgtgtttactgaagttatacgcatgtacaactgtggcatttttcccttacaagtcgaatgtttaaactctaccattttgccccttagtgacttgaggcatttttcccttcccagttgagtattcctagaggaaggtcatataccagttaaactctaccattctgcctcttagtgtgcattcttgagcacacttactcaacttctgagatcttattaggaaactgctgatcaccagtttctggtgtttctatctattaggagactgcttttccctggcatgggctgcaaccaataattcttttagagagacagtttaacaactgcctgatcataacctgatcgtctcctggcattcctggtggttggtagggaggggcctctcctgccttgctcatgtctgcctgactacctaatgtaacatgtggagcagaggaaaatttacgaaagatagaactatttaaaactaccactataatctgagcagcaaatgtttgtgaaatcttgtaaatgtctctaacaaatacaacctaataggttgtatatttataatagtatttataaaaacataaaaaacacaaaaggtctaataggttccctacagtaatgccctaattatgctttaattcatcaataagaaaattctggtttatgttgagtattccacatttacacaactgggacaaaattaaaagagtataccatgtaaatgcagcgtaaaggcatcatttgtatctacttggaagagtctttctttgctacttcatgaaattatctcatttgttttggattgcaatacagaatataatgaacaattttaaattataaaaatagaaaaaaaatcagtttatgttgctcatttacccacagtaaagacttttgtcacggcatgctaaaaatactttagaaagattttactgattgctttcatttaactgccactttgccatttattggcttaattttgcacagaatgaagcacacttaaaactcaaggaaagatattaggttttagttttacacactccatcatgaaaataataaaatgaagaacggatttttttttctttttttggtatttgccaagtatctctcaaaaaaaaagaaaaaaaaagccccaaatctctcaagtcactcaagacaatctaagcacacaaaaataagcatattttccttttatattcctctcgaattcaaaccaatatctatctcattttacaacacatgccattgtctttcaaaatatatgaagtaatcaagtaaaatttccacagtaaaaagccatatcgtaattgggaaaaatctttactttttaaaggtttttttttgtgtgtgtgtgtgagacttgcttcaaagcagctctgcattttttcagtgtaaattaatgagcttaagtaaatatccttttgtttaaataaataaaggagctatgaaagtgcatccatcaagagctaggccattaaattgaaacatatctataactacttaattatcagaataaatgactgtgctaaaagaggacaggttgattaacattttttttgttacaaacacttgcatattaagtgatagtcaagtttttgtgaatccttttgctgttgaaatgtttcaagggatcatctaacatatgttcaagttaccagcagaaaaaggctatatgaaacaagcatacatcatccaatagcatgagtctgacgacccctgaatatgacctgctcccagaggaaaccaatataatgctctatcgcacacagagtagtatgtatgaatgacagaacctcctgataaattaatgacaggtacatctgaataggattccttctaagtcacttatctgcagccaggcaaacttgtctcaccctcactttcaaagataaagccacatggcatgtttccttagcagattctcacaaagcaaacagcccccattggccattattggggaaaaaaattccccttattatttcaggtaatgtgacagcaaatggtataaagtgaaaactatcttccagttgaaaattcatcatttacccctctctctcaactatcaggccttacgtcctctctaactttcacaggctctgtgcctcttgctcttttacttttatttttgacagttctgctatcccagagttgtagccatggcagggttcaagaacaaaacagcaggctatcaaagacaacttatcacaggccaaacagtgagcagagatggccaccattagcgagtagccaaaagacagactgatgacagagcaaagaagaaaagtgaaccaagcttcatcattaactgatagcttattctgtttagaaaatccaagagaaaaactgggataataaatatatgtcctaagtatttaggcatattagtcacagagatttttaaattatgttaaaaaaaggcatggaaaatgtttatttgtgagggatcttatttacacactttatcaaccataaatacattggaatagcaaaaccatgtaaaaccatatgccttaaactgaatatcagttaatagcacaaatacattatcttcttcagagttaagtatctattattcttttaaactaaacagtaaaacaaacatatcaattctcactttctgtattccttataagaatgcagaaattgcacttaatcaagactatctcattatatatcttaacaaatgccatatcatattaccaggacagttatatagcatagtaaaattcagtaacacaaatcaacaggactcacgttttagtttctgtagagatagcctttctcacgcagaatcagggctgtgctttctgggtgagtctgtgttaaattaaaatgacaaaaatcttagtttctcattccactgtcacttagaatgcatgcaaataaactcccagttagtcaaggggaaaaaaattgcattaaagagtcctgatttgtaaatgtggtcttttcaaatgtagatgatgtttacccctctctctcccccaatatctttgcaaaatttcagcccaatgaactcattgctgtagaaacttaactaaggctatggtcagttaatgaaattcaagtctgggattaagctccataaacatgcaaaatggctgggcatctggaattgggagagacatggatgatgctggaaagaaaaagaaataagccatgtaacttagagaataaacaatatgatcaatttagctaaattatctgttgtcctatatatgaggtgattcacagtaccctaaatgtttaagaaataaaagcaaaatgttttgaaaatattaccaataccatatccaatgacactttgggggatataaatatagctactaaatttaccttctttgaaattacacaggtttaattagattggatgtatttcctttatagccgcaataatttaaaccacattaaacaccattcaaaatatgaaagaacttcagttagtaggcaataaaaattattatttctggtctatttagctactatgttatagtgttacttgatttgcaatgtacttcaaagtcatcagtaatttcttagaagttttagcaaatgcagaactaagatgttcaattaaaacattaaactctacctgtgaacctccatattataataatgttattttattttttatgagttaggaaaatgtaaaaatgtattcagaaaaattcatttgaatatttaaaattttaactgctatgtattattccccagtttatttaaattatataaatgcatagtcataatagtttttccattattacatgtcaagatttttatactgtattatggaatatttttgaattttctagttaactatccattaactcaacaaatataaatgtagatcaggaagcccttaacattccctctgcttgactgaactatatataggtttctttctgactctaggcccctaacctctttttacttagaacatttatttcagaacacttgttattttattatttttctacccctttgagatgtaaatcttctctctgcaccttgctagttttacaacccagtaaagtctttctctaggatccagagatacatccctttgaaatgtaaacataaagaaaaataatggccttatctcccagtctctatgggagagtataagcctaacttagatgagcaatattagcaaacacagatggcctgataacactggcaaatcccctcactaatatcctctggtagaatggtttcttggggttggttccaggaacctcacagataccaaaatttgtagatgctcaagtcccttaaaaatcatctctagattgaggagagccaaaattacctggtgaccatccagaggcaaaactctttatctgtggaattcagaagtaattatactgttatttaaagcccacatcttgttccaggtttctttgcaaaaaacatatagtaactagaatttctatacatctctggaatgcatgactatcaaaactcattgtgcaacccttactgacattaaggcaccaaaatgtctacaaatgtaatcatttatcatgacctacatggctaatatggtccaaaatactcttaatctcccgctttaaggtccatatatacctctaaagaaaaatccaccatggcatgctcagtcctctcttgctgaagcgtcccactgcactcttctgcagtgttctttctaacaaaaccttccttttttaaacctatactgatgttgataaattcttcttaccaacccttgcgtcaaccactttccaatgcctgtactttgccacctccctggcatagattacttaataccatgtaagtgttatgtaaatagttgctatcctgtatttttatttgtattatttttattgttgcattgttactttttttgttttccaagtattttttattcacagttggttgaatcccatggatgaggaacctgcagatacagagagacaattatactttccactagttcacctaatttgcgaacaatcctaccaccttgtgtttcagtagagttcagttcaatatctccccttctttgtaataaatgccaaatacactactaatcttataaatcttccttgcctgtttaactctaagtgcaatttttctttcacattctcaggtgtctattatgtgccagcaggcactctgctaattcagtgctgtgcaaggtatgccttgataatacctactatctagcacaagactgatacaaataatttgatatttaaaggacagtgataatgctgtgtctgggaaaacagaagggaggtgcctgataaaagaggaacagagaataaaaagtataatagaggaaatatcatcaaagccagtcacttcatggtattatccaggcaattttcagtagggaaaacactccaggaggacatcagcacatgtgaaaacctagaaagaagataaacattacagtatgaagacaagaaaaatcagaatggctacagtgtattcagtgaaatgggaggggtgtcaggaaatgaggctaaaacaaaataagagaaaggaaaggcacttatttttcaatatttgtatgcgagttcacttttattttaatcaatagattaatgagcaagacaatataacttaatattcactgccaagggctttggtgtcagactaacaggttttgaaatttgactctacctctcataagttgtataatattaggcaagttgtctaacctctctaaacttcagcttcttcatttcattcataaggatagtacatgaagttttatgtggattaaagggaattgtacctaaaatattaacttaagtcttggtacacagaaaatgatcgatgatgatgatgatgtggtgatgatgatagaaaccaatctatgatactgacagtgaagtacacatatactatatactaggtcctgggagttacaaagtgtttgaagaaaacagaaattgctggagtgtttttaaaatggaaatatattatctaatttacattttgaaataatattctgatgtttttaaagttgggaagtggctgggcatggtggctcatgtctgtaatcctagcactttgagagtccgaggaaggtggatcgcttgagcctaggagttcaagaccatcctgggcaacatggcgaaaccctgccacttaaaaaatgtaaaaattagccagttgtgatagtcccagctacttgagaggctaaggcaggagaatcacttgagcccaggaggcagtggagatggcagtgagctgagatagtgccattgcactccagtctggacgacaggaatgaaatcttgtctcaaaaaaaaaaaaaaaaaaaagttgggaagtgaatgttataattcaggcaagatacaatagcggtgtgagaacagatagtagaagctaaaactttgtttgagtaaatatttgcagatacattaactaaaagtcgacatttactgaaatgatgggtttataataggatggcctaataataggataaacatacttctgctttttaactgttatctgaatgtaattattaatagcagagccttctacttataaaattatccttgtttggatgatgaactatgttgtagaagtctttgtaggaatcacttcatatgttttataagagaattgtttaatcaagccaatcaatcgagtggatgacatcttcaaaatataatatagcagcaatcataagagaaagagctttcaggtgcaatgttataaccgcccaatgggttcaccttgcctgcagcctagacagagctgatttaccaagacaggggaattgcaataaagaaagaataattcatgcagagcccactgtgtgggatactaaagttttattattactcaaatcagtctccccgaacattcggggagcagaatttttaaggacaacttagtgggtaagggtaagccagcaaactgggaatgctgattggtcagggatgaagtcatagggagtcaaagctgtctcttcccgctgagtcagttcctgagtgggggctacaagatcagatgagccagtttatcaatctgggtggttccagctgatacatcaagtgcagggtctgccaaatatctcaagcactgctcttgggagcagtttagggagggtcagaatcttctagctgcgtgactcctaaaccataatttctaatcttgtggctaatttcttagtcctacaaaggcagttgagttccccggtaagaaggaggtttgttttgggaaagagctgttattgtctttgttttaaatgataaactataaactaaattcctcccaaagttagttcagcctatgcccaggaatgaacaaggacagcttggaggttagtagaaagatggagtcggttaggttagatccccttcactttctcagtcataattttgcaaaggcagtttcagtggctgacgcctttaatcccaccactttgggaggtcgaggtagctggatcgcttgaggttaggagtttgagaccagcctggccaacatcgtgaaaccccatctctacaaaaatacaaaaattagccaggcatggtggcacacacctgtagtcccagctactcaggaggctgaggtataagaaccgcttgaacccaggtggcagaagttgcagtgagctgagatagtgccactgcactccaggctgggtgacagagtgagactccatctcaaaaaaaaaaaaaaaaaaaaaaaacagagagaaagagagaaagagctaatatttatttgagcacatttatctgtcagatgctgctttatgctgataacatgcattatgtcatttaatgccgaaaacaaccctatgaagttggtattattgttattattgttatccctattgtacagatgaaaaaattggagcacaaagaggttaaacaatctgtccaagttacatagcaaatgaaggcacatgaatccaaaccagagagtctgcctccagagtctgtgcatttagcccctatgcaaaaagtgccagaaatagagtagttttaagagcaggcaatgctcatatagggctactattatctaagaagatagtaaagaatcagctgtgggcaatagtagaataaactatgtcggcaaggtagaaagcacaaagatgatgatatcagagtagcttcaattaggaaatgatatttcagatagattttaaagaatgaaaagaatatttgcctccttaaaaggtctacttcaaatgaaaatttataaagatacatgtttttccttgattattccaatcaaatttgatcactcaatcttctaaatgtctttgtattaaacatatataaaaatatgttttcttaccacagacagatctgagatcagcaacattctgagaaacttccatacacttacattatttatatgaaaatttacaattcaaactatttatcttagcctctctgattaatattctatcttatagtatatacacacacacctacacatgcacacacacacacaaagacacacagagcaaattttagtatccaagacactcttgccacaatagtttttcttttcctcaagtacgccaaactttggcctttttcctttctctgtttaatcttttccaaatcttagattggtagctctttcttatgtttcttctaggctacagtacatagagcagcactttggttttattttttaaaatcttctggggacaaagcctttatctagatattgcaacttctcctctgctctacttcctgtaaagatgcttgtccccatttgaacattgaatatattaataagtgagtagataaatttggcttaattctgaagttcttgtccactaatataagttacaatctccagattagcttttataaataacagaagagttcattttgcttcatgtgcttttattctttatttcagtcagatattaagtaaatcatcttaaagaacataacataatttatatcttcaaattacttctataatttttatccacaatgtctgacactcagaaataatcaagtaaaagggaagtcaaggcttgattaaataccaagagaaaaataaaataaccagggaaattagaagacgttttgcatcagatgaatgaaaataaagcagtgtttaaaaaatgtttagcttgaaagcctatattcaacaaaaagaatgatttaaaataaccaaagcagccacattaagaaactaacaaagaaaggctgatctaatttccaagcaagaaaaaaagaaggaaaccataaagattctatagaagaacaataaaatagtaacagaaagataaaattgtagaaaaatcaattaaagcaaaagttgactcacttttcagataaaagctttgataaattttggttaaactggcaagcagagaagacagaagacacaaattttaagaatccaacataaaaggatatcattattgatgactctttggaaataacacaggttataaagatactgtggcttggaactagaagacctacacagtggaataaccaaatagaagaatcctgggttcctcatagagtgaacatgatagtgtgtgtacactggagagacataaaggagttcagaagaagtcttcacaagtaaacttttgaggttactctctcaccttaaggcccaagtttaacctggttgattttaagttctttaacaagaagtttccaaaatatttaaaagggcttataaaagtaaatatttaaaagggcttataaaaaaatataaaagtggccaagatggctgactataagcagctagtgcttgtggctctcacggagaggaacaaaaggggcaagtaaatacaacaccttcaattgaaacacccatgtactcacattgacattaatcacagaaacaacttgacccacagagaatgaagcaaagcaagacaagacaatggcccacctggcagcaacatggagtcaggggatcctccccagcccagggaagccataaatgaatgagccaccccaggaaactatgcttctcccacagatatttgctaccctagggtcaaaagatctccttgtgaacccactccactagggccttcaatcttcagtctgtcagacagagctacatggagtctcagcagagcagctgctcaggtgtgcatggaaaccatggagccttagatacttcgactttctggcaaaagtagctgctgctctagcaaagtagaaggttagactcctgtacataaccccaggcaagaggctgaatccagggggctgagcagcaaaagcccataggctgcatttccagagcacctcacaagattagacccactggcttaaaattacaatcagctaccagtagcagcactgcactcccctaagaaggatctcccagaaggagggtcaggctcccatctttgctgttcaggagcctttgccattccagccttcaggctttggagagcctgagccaacccagggcagatgggatcccccagcacagcacagctgctctaccaaaatgtggcctgactgctgctttaagcaggcactcaatcctgggcaggacctcccagtcaaggccttcagccacacccacctgagctctccagccatcagacatctgaattgccctaggacggcactcctagaggagaaggtaggtcgccatctttgctgtttgggtgacttaaccattcgagcctttgagcattggagtgcctgaggtgacagagggctgaagtggacccccagcgcagcagagctgatttaccaaaatatggccagactgctttttttaagtgggttcctgtcaagttccttctctctgggggggacctctcaactggggtctccagccatttcttatacatgcttataggctggcaacaggtccatacctccctgaaacaaagctcccagagggagggacaggctatcatctttgctgttttgcaaccttcactggtgatgcctccaggttctggaaaatctgaggtgactagggaatggagcaagccccaagcatagcatagtagccctatggaaaagtagacagagtataacgtaggtgcttgtttccatgtctcctcagcaggcaggtcctccaggtctggtactccagccacccctgaaggagctatcaagacagtaccaactcagcaactccctggaaagagcctccaggggcaattcaaagcctctctgccactgcctatgcagtggaactgcccttgccatccttgggctaatgaaggagcaaagaccctaagtgcctcatccacacctccatcaagcttcagccaattcaaggagaggtgtcagtctgtctcccacaggtcccacatacgctccatggctcatcaccacgcccggctaatttttttgtatttttagtagagacggggtttcaccatgttagccaggatgatctcgatctcctgatctcgtgatccgcccacctcggcctcccaaagtgctgggattacaggcgtgagccactgctcccagccatggtttttttttatattgtcatatatttccagtatctaatgcaatgtcagcctcaataaatatttgatgaatgtaacttggcagttagccatgccttttcagtgaatgattcataggaaacacccaatgcaatcgattgattataattaccaaagaaagatcgctgcaaacagaatgtattacatgttgttttcctcatcatgatgactgtctttactagatagggtagaaacataagtaattcaaaaaaactaaagagtaataaaacgactcaaatgagattgagatagaaagctcagggctgttttggaagtttgtggtcactaacgactcaggattcttgctgctttgccactcttaatggcttctacctttaaattacaacattgctacttcagttccaggtaaactatataggctccagaaagcagaagacaggaagagatgagggcaaaagaaacatacatatactggttgagcatgtccaataaaaagagctgttcttgacactgacccagtaacttcagctttacatgttattgaaaacacctttcaaaaaggaaattgaaatgtagatgttttgatcaatgtatcgtcacctcaaacaatatactgatctgttagtaagatagataggagaaatataaagcatttttctcctcccttatggaatgtgtccatttttagttatttgagcatattgcatcctaaaactgttttttttaacaaaacctattggaaatatgtcttggaaaaacatatattttattgtatattttcctttaagcctattgcccaaaaattctaaacaagggaagctcagtattagaaatggatttatggttcaaaacattaaaaaattgagaaatgcattgtgtaaaaccgaaagacaaacctcacctggattccagatacatacatgaagatacaacactatgtattacactgtgtacactttcaaatatatcttcatcaaaaatcagacgagacatcaacatcttatctatcgatcttccccaactaccctcttctcaactcttatgaagcctcattcagttaattctttatgtaaaaaactattgaagttaagccatagcagcaggaaagctttttttttcttttcatttttgaatgtgttttttttataggtctgtgtgcttacatatgagtgcacgcctgctgtttggccattctttcacaccaaacaatgaatccacacagagataacctgaattgggagtttagcagtgctgccatttcttcattctacctttgtttaacttttctgtcactagttctaagctaaaaacagaataaattgccagaataaagtaagaattgcagattctcaaaatgtataccctcccccaatgcagaaagatagtctgatatttgaattcccaagggaatttcttcagaaacattgaataaatggggttgaaaaattcaaggatgcaaacacttaagaaaggtatggatggactcaatacatttaaaagaaaaacattctaaggattcaagaatgaattacaatttgaaatgaaatcatttttatatttgtgcttacttttaactttagggactattctatcacaagggactttgcttttaattgattaggtaaggcgctgaagaactaaatagactactctttttattccttgacagttttgctgtttcaagaaagaaaagcattcctgggccaaaagaaacatgaactgacttctgaaaaataacacttttaaaattttgtcaaacattgttaatacaattatatgaaattaaattatctctctctactgtttcttcttagtgtgtcagaaatactaaacaggttccaattgattgtactttacacacattgaatacagactatacaaagtgtttaaagatttgtaagatttaaaagacttatttaagaaaaatgtcattttctttaagtgttaaatagacagcaatatagttctatctcttctcggtgtgtgtgtgtgtgtgtgtgtgtgtgtgtgtgtgtgtatgtgtgtgtgtgtgtgtgtagcggcaagaggggcacattgagaggaagcacaagatttctctagaggaagctgttgcccactgcattaatacatgtgacatattgacatatttaatccatcaaacataaggcttgcttccatttagtttgtgacaatttgaacaactatgtacaggtaaatacattgctgttagctttgtattttctataaacactcctaaggagaattaagataaaatcactgaagaattattccactatttatgcatgatgttttaatgtgttccttttttattttaaaattttaacacaaaatattttgaacagacaaatatgtcacacaaatgatacccaacataatgtaatatacttcagtttcaggaaaatgttaagaacatcatacataaagctgtgactgaccttaagtttctaaagaggaatcaagctgcactcacattacttgtttgcttattttttatgctcactttcttatttatttatttatttttattttattttatttttattattattatactttaagttttagggtacatgtgcacaacgtgcaggtttgttacatatgtatacatgtgccatgttggtgtgctgtacccattaactcgtcatttagcattaggtacatctcctaatgctatccctccccccttcccccaccccacaacagtccctgatgtgtgatgttccccttcctgtgtccatgtgttctctttgttcaattcccacctatgagtgagaacatgcagtgtttggttttttgtccttgcaatagtttgctgagaatgatggtttccagtttcatccatgtccctacaaaggacatgaactcatcattttttatggctgcatagtattccatggtgtatatgtgcacattgttggacatttgggttggttccaagtctttgctattgtgaatagtgctgcaataaacatacatgtccatgtgcctttataacagcatgatttataatcctttgggtatatacccagtaatgggatggctgggtcaaatggtatttctagttctagatccctgaggaatcgccacaccgaccttcacaatggttgaactagtttaaagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgattttctaagaataatatttcttacagaaatagcaaaaagggattttagtggttaattttacttccaaatttcaaccaaatttaaatgctatttatataaattgtgcccactattttaaatcctggtttgcattataatatgcagcatcagaagaaggccacctatcatttgctatacaaatatgggctataatactaggtagtttttttgtttttgtttttgtttttgttttttgacagagtctcacttcttcgcccaggctggaatgcagtggcacaatctcagctcactgcaacctctgcctctcagggtcaagtggtttttctgcatcagtctcccaagtagctggaactacagatgtgcaccaccatgcccgactaatttttgtatttttagtagagatggggtttcactatgttggccaggctggtctcgaactcctgacctcaagtgatctgcccacctcggcctcccaaagtgctgggattacaggtgtaagccacagtgcctggcccatagtttgttctttgaagttaacaaaccacaatttgtttaactattcacctgttgaaatacattattacaattaataaaaatatgccacttaaaatgctttcaattctcacattggaggataactgcaacttttgttgttatgcctggtgtgatggttaatattgagtgtcaacatgattggattgaaggatgcgaagtattgttcctaggtgtgtctgtgagggtgttgccaaaagagattaacatttgagtcagtggacagagataggcagaccgatcctcaatctgggtgggcaccatccaaccggctgccagtagggctagaaaatgtacgtggaaaagtggaaaaaggtggaataagcagacttgctgtgtcttccggccttcatcatactcccatactggatgcttcctgcccttgaacattagactccaatttctctggcttttggacccttggacttacaccagtggtttgccaggggctctcgggcctttgggcacagactgaagactgcactgtcggcttccctagttttgaagtgttgggacttggactgatccaccactggcctctttgctccttaaattgcagacggcctatggtgggactttacctgttatcgtctgagtcaattctccataacaaactccctttcatatatacatatatgctattagttctatccctctagacaaacctgactactacacatggcatattttaaaaacacggccacattaagtctaattataaaatatgtagtatttcatcactgaattcatgacttacagagaaatattaagtataaaaaaacacatggcatattttaaaaacatgcccacattaagactaattacaaaatatgagtatttgatcactgaattcgtgacttatagagaaatattaagtataaaaaaatactgattcctttcagttctatgcttaattaggagagccagtctctgagcacctttggaacaaatcccgtttgtctcagttccaagagtatacattgtcaattactcatatccctaggaactttacctgccaatgctaccttagctcccaataaaattataagacattttcatatttaagtacttgtcacctcgtatagacacatatttacttctggttctggtagaaaagcagcatggataacatttaaattatggttcattcattgggataggccattttacaaagagtcaggaaaaatcggaccataagcatagtccccatgtttcctagccaacaattcctgacacttttattacaaaagcattaaagtaaaattgttattttaactttacttctccttttttcctttgaactttcatgttctgtccttttaattttaattcacatcaagttgataaaatcatattttattctgtaacaatgtgccttcctaattttttctttaggcttattctaagtgtgataaccaaattaataaacatttccattatttgaaagatacacacacaaacattgtgtaactgttgtttagaatgatgtgtgtaaattatacttcttcaaatttagtccactgtgacaaaccttggatcaataaaatattcctaacatctagatgaattaaatgatttttatttacacttattgttcgaaatcattccacattttactttacctgacacttcagcaataaatgtgctacttctaaaagttgccttgcttgttcatagaggactcaaatacttttattattatattactaatatcattcactccttaatctttttcttcattttaaaaaatagaattcatttttctttttaagatattcttagaatccactgatattttaacttaaattcaactagctgttttctaggcctgttacctagttgggattttttttttccacataaatcttcagaatgtttcatcatttcttgttgctatgcatttctcttccttggattttgctgaattatatgcttaagtaatttcctcacaaaaggatgtatttcaaaataaattgcatacattattgctacctaaaactacatttatgtggccctggcacttgaatgatagcttgtctggggatagaatttcagaatttcgaaggccttgcatcaccatcttttgagcattttactcatgtagctttctgtatgaatctcattcaatagtacgtggttttttagttgtttaatttttttaaaatatgtttttcctctgtgaaaacttctgactcaatcattcgtgatgtttggtatattacaatgatgtgtatttatatgagccttttatcattctttttggtacttggaaacttttaaaaatcttgtgaccattttcctcaatctgggaaattaaaattgctctattaatagattttattttaaataattattatcaactttgtggaattttctattttatcacttttattataatatcactcagtttaaaaagatgaaccacacctactgactaaaattaagcattttgttagaattattctgtttgagctcaatagcaataaacagctcaatttaattttcttgaaactaaagttcttattgcttgggtttatttccactatattttacagatatgtggtaaccatgtccttgaaatcttattgtaaattaactaacaaagaactgggatatattttcactcataatgccagatgattggtgtgggaaattagaccaacactatgaatttatcttgctcagagaagctacttcctacccttttgtggtcagtgaaccagggcagatcattttaatcccataaggggtggaggtaatttaaggctgggtaatataaggccagatggctcactatacatctggctcatttccactgctagtaaacgttgtattggtattcccaactatgatcctgcattgtttacagagtcctcttccttgtaggttcctgagctcaaaatatcttcctcactgtagcaatgtcaaatcctctgctctgctttctagccacattctgcagagcctcttgtaaaccctctgtttttcttttctttgtaccatctaggaacgaactagtgcttcaaccagctaggaactctgctcattctacactttatcagtgcatttagaaagtacacttggccactgaaaattacgagctacaaaaacttcaagttaatttactctggatcacatagccagtaagaagcagatttcatacattactcagttttgttttgttttaactccaactttcagtacatctttactatggacttgctacatatctactgtgacaaatctcatttgttacgaattatctgttgccagtcaatattatctggaattgttaaatttatcaataccttctttctaatctaaaatgtaaatataatttattccaaatataatttattccataaattctttctaaactaaaatgtaaatataatttattccaatataaatataatatattccaaagttatataaatgttttaggaagtaagatgatacaaccaaaaactttacctatgtgatttcttgacctcctgtgctatgtagttcaagaatttggcaaattctttgaaggggaaactcaaagtttagggcttgcttctcttatcctttcttttcctagagattattgcccttgtatcttggataattcaggaaccccagactttaacatatttctcaagctctataccattgctgaaagctctgcagcccttatctggtcaccctctcttgctgcctggtatagcaaacgtcccaaggaaaaatgaagtgggctgaatgttgaactcaccttaatgggtttcttttgctattagatttggtcacaacttctgttttattcactgttgtattctaactgtgtagcaggtccatggtacaaggcaggtgtgcaataaatgcttaacaaataactaaatgaatgatgaataccttcaaatttattttacagagcaagcgtaagcctagtgacaaagcaagaaaatggaaactattgaccaatgcccgattctgttgcaactatagtctagatgttatttaagataatgatatcaaatggaattcacttatgcataaaagaaaaaagaacatacaatgattaggcttgtgccaaaaatgtaagattgctacctataagaatatatacacaagcaacacattgtaaactgtggtttacatattcagaaatcaatttgcatttcaaaaatctcttcaaatatttgtaatagcaacaattagcaatttttaatatattttacaatagactgaaatgtttgatatacaattctcataagattgtggtggaactcacataattatgcatttctggtggtaatacaaattgacacaatctctttctagagcaactgtattttatttactttggtagttttttatttacctttatagacatgttgtttttttaattttctttttttcccaccatatatatatctatatatataaacccagttcaaatatatgatatggaatattaaatatattgattgatattaaatatgtgaatatatgatatgatttctaaatccttctctagtatacagcagtaaataagatgtacttcaagtacaatactttcatttctaagcagatctctggcctggaaaaatgaaggtttctctagagatgtactagaaattgtttagttccaaacctaggccaaatttgcctcacacatttccttcttgtgagactgtattataagacattttgtttaataatgatatataacaatacctgtactcttgttactcaccaatttctgttacaaaaataagtagagatggtagtagagatatacatatattttgtcaaatatttctgcagatgcagagataatgtacaggaataatcaagaacaatgaaacttgcctaaagtagaactaaataagggagagattgtcaaatacatttataaattataacaaaataaatggaaatcaaaattaattaaatcacacataatcctattatcctaacataattattgccagtaagataattttgaaaagcagttgatgaaaaattatcagaaactataaatattttttctttcaataatttcatttctggtaattaaccctgaggaataaaatcaaatgaagaatgctgctttgtacattgacatgttcagtttaaccttaattttaatggcaaattgttaaacaatctaaatatctgactggggaaatggtaaattattgcataccatcttaatcagtccttaaaattaagatcctaacgactatagttacatggaaaacgcatttgatataatgcagaaaaattctgtcaaggccatcacagttaaaactgaaactattcattatatggttgataagtgaaagaggcttaacacagtttaatgtatgaaagagttacattaggatagttggattgctgtgagtttcttgtgattttgtcttcctcttcttataataaatgtgcaaaaattatgggaaaaatatagaaaaattgcagataaataagaagtgaatttactaagtaacaacacttgaataaagagcttattggcacttattaattgatacttatttgaaatcactgctaatgcatatgaagttaaataagattttacttgtactgtctagtgcagtctgttataacaaaaacaatgaaaagagtttcctggtaatattaataatgtcttatttaacttgacatgctttaaagtctaaaacagtggcttaaacatggcaagttattgataaatacttactgattaaattttgagactataaaactttgacatccttgaaaaaaattagttcaattatttagtatgtaatatacatggatcaaaactgttacaataaagcacagtaaaataattctccttcccatcatcatctgctagcacttttcctatgtatacgaacacctatgtatattattttcctccttttcacaatgatagcatactatatgtaatttactatagattgatttattttcaattaacaatgtatcttggaaatctttccatatcagtacaaattgtacttccttattcccttttatgaccacatagggttccattacatagatacattatacttcttcctcattcaaaaacacctttcagttgtttcttagttgcattttttggtctgctaaaatacatcagatcaaaaagtgaagtttctcatattttgtaaagcttcctatcacacacaatattaatttgttaataaatcttaatgatttaccttagaaacagatggtctcactcataggtgggaattgaacaatgagaacacatggacacaggaaggggaacatcacactccggggtctgttgttgggtgggggaaggggggaggggtagcattaggagatatacctaatgttaaatgacgagttaatgggtgcagcataccaacatggcacatgtatacatatgtaacaaacctgcacattgtgcacatgtaccctaaaacttaaagtataataataataaaataaaaaaataaataaataaataaataaaataaattataaaaaaaaagaaagagatccagaatctaaccacttctcactgtttccattgagctatcattatctctcacctggattaatataattgcctcttaaatggtcctccacttttcaatgcttatctcctctacagtaaagcctcaaaacaacagatagtaggactttttaaaatgtatgataggaattgcagaattggctaagatagagtaattatgtcacactctcttccgctgaataaaattaaaaccctgggtataatacataaacatctagagactctgaaaaataaataataacaagtttgctgaggagagaaattaaaactcaaagaagaatcccatggggtgagttctctctgcactttattctcccatctcttctggcctgaatccaataaatgtgcagcagacacagtcaccaaaagctccaaggaaacttatctcattgtggtgcagactctaggaactgtgaccgctataggacagaaagaatgagaggaaattttcatgtcttgactttctctttttactctccaaggtctgtcccactcaagcactggtcatgaagctgcatttccatggtggagacagtgcaactggtagcaatgatggtggcatcagtggacttgctgataattaaaatactcagaaaataatccttctctctcattatagaaagtggaaaagatgcttttgttatctaaagtgaggaagcaatccctttccctctctctgcctctctctctctctttctcttctcttactgctttgccccaagttgaacagaattgtagatgtgcacgagcgtaatgaggcaaatactctggcctcatagctagagtaccaaatcaaggcctccggtatttagagagtacaaggtaatcaagaagaggatggaactggagaaaagctggagaaaatctgtacaaggagtatacggttcatcccaacctatgtatgtgtggaactgaaccaacacatgaaaagttcgaaaaaactttgatatgatgaatgtgaatttccaggtgacaaattagcacatggttggtggacatgctgggcagaccaaaatatcactgccaaggatttttttactatactgaaattgaaattatagtgaatagaagttgggtcatatcattcagtctgaacctcatctatttgcctgctaatacagacaaacaagtaagtgcaacaaaacaaacaaaaaaatctccagaagattttaacaggacccatagtattatacagtaatattttaaaactctaaattacaattatctatcaatctatatatagaagaactaggcatagctcaactactctcaaagagaaagccaattaagaaacaatgaccttaaaataacctatgttagaattattagtagactttaaagcagatattataaatgcgtctcgatgaaggcaaaagcccttgaaatgaatggaaggatagaagttctcaaaaagaaatagaagttataagaataaaccacagaaaattttaaatctaaaaattaaaatgctataaataaaaaattcactggaaatgaaatgacaaaggaaagaattagtgaacctgaaggtatattaatagaaattattcaatttggacaacagagagtagtttgaacttgaatgtaagtttgaatctctaaaaagtatgcaacaaacttgtggctcaaggctgcaaggtatcattatgtgtccggagttggttccttctggtgggtttgtggtctcactgacttcaagaatggagctgcagaccttcacggtgagtgttacagctcttaaagatggcaaagacccaaagagtgagcagcagcaaggtttactgtgaagagcaaaagaacaaagtttccacagcatggacgagaacccaaggggggtgccactgctggctgggggcggccagcttttattcccttatttgttctcgcccttgtcctactgattggtccatcttacagagtgctgattggtccattttagaaacgtctagctagctacagagtgctgattggtgcgtttttacagagcactgattggtgcattttacaaacctctagctagccacagagcactgattggtgcatttttacagagcattgattggcatattttacaaaactctagctagctacagaccactgattggtgcattttacaatcctacctacagaatgctgattggcacattttacaatcctcttctaagacagaaatgttctccaagtctccactcaacccaggaagtccagctggcttcacctctcaattggagtctcagaaggttagaaaaaagttagtcaaaaaataatatttgaagacagaatggctaaatactttctagatgtggtgaagaacacaaatttacagatttttataattccagaaaacaccaaataggataaactcaaataaaaccatgttcagatgcaccataatcaaactggagaaaaacaaagataaatgtaaaaccttttaggcaagtggagaaaagtaacatattgcataagactaaaagacaggacaacatgttgaaagtgttgaaagaaaacaaaaaaaattgaagacagatacacataatgaaaatatcctttaagaataaaggtggaataaaaacatttttaaagaaaaaaataagcagaatatttttgtcattacacctgcttttaaataaatagtaaaaaaatttttgaaactagataaatattaactgaaaaatccagaacattagggatgacaaaataaaaacaacagtaatgacaactgaacaattaaaataggctgtattttgcctctgtacgttccttaaacttaattttataactttgctgttataaaagttataaaattatttgagcagttttcaaagtatgtagatgaaatacatatgatagccactccacaaagagggggttgcataaataaagaaacccagatggtggtaagatatctagattatatttgaagtaataaaatattaacgctacatacagagtgaaaaattatatttatatattgtaattcctagagcaaccccaaccaaatataataaggtatgtagatgaaagtcaaaaaaatttaaatggattaatatattttgaaagaatccaagaaaaggcttaaaagtatcaatacagtaacaccaacaccaaaactgacaacactaccaacggcaacaaaaagagagggaacaaacaaaaatccaatcacaaaacagtaaatttaatctaaccgtatcaataattacattaaatgttaatacacacactaatttggatcaggttccaagatggccaaataggaagaactccagtctacagctctcagtgtgagcaatgcagaagatgggtgatttttgcatttccaactgaggtaccaggttcatctcactggggcttgttggacactgggtgcagcgcacggagcatgagacaaagcagggcagggcatcacttcacatgggaagcacaaggcgtctgggaattccctttcctagccaagggtagccgtgacagatggtacctggaaaatcggatcactccccaccctaatactgggcttttccaagggtcttagcaaatggcacaccaggagattatatcccgcgtctggctcagagggtcttacacccatggagactcgctcactgctagcactgcagtctgagatccaactgcaaggtggcagtgaggctgggggagaggggttggccattgctgaggattgagtagataaacaaagtggccaggaagctcgaactgggtggagcccactgaagctcaaggaggcctgcctgcctctgtagaatccacctctgggggcagggcatggctgaacaaaaggcagcagaaacttctgcagacttaaacctccctgtctgacagctctgaacagagtagtggttctcccaccacagagtttgagatctgagaatggatagactgcctcctcaagtgtgtccctgacccccaagtagcctaactgggaggcacctcccagtaggggccgactgacacctcatatggctgggtgcccctctttgaaaaagcttccagaggaaggaacaggcagcaatatttgctgtcctgcaatatttgctgttctgcagcctctgctggtgctacccaggcaaacaggatctggagtggacctccagcaaactccaacagaactgcagctgagggtcctgactattagaaggaaaactaacaaacagaaaggacatccacaccaaaaccccatctgtacgtcaccatcatcaaagaccaaaggtagataacaccacaaaacggggagaaactagagcagaaaagtggaaaattctaaaaatcagagcacctcttctcctccaatggaatgctgctcctcgtcagcaatggaacaaagctggatagagaatgactttgacaagttgagagaagaaggcttcagaccatcagtaataacaaacttctccgagctaaaggaggatgttcaaacccatcgcaaagaagctaaaaaccttgaaaaaagattagatgaatggctaactagaaggaacagtgtagagaagaacttaaatgacctgatggagctgaaaaccatggcacaagaactatgtgacacaggtacaagcttcagtagcctatttgatcaagtggaagaaagggtatcagtgattgaagatcaaatgaatgaaatgaagcaagaagagaagtttaaagaaaaaagagtaaaaagaatcgaacaaagcctgcaagaaacatgggactatgtgaaaagaccaaatctatgtctgattggtgtacctgaaagtgatggggagaatggaaccaagttggaaaatattcttcaggatattatccaggagaacttccccaacctagcaaggcaggccaacattcaaattcaggaaatacagagaacaccacagcgatactcctcgagaagaacaaccccaaaacacataattgtcagattcaccaaaattgaaatgaaggaaaaaatgttaagggcagccagagagaaaggtcaggttactgacaaagggaagcccatcagattaatagctgatctctcagcagaaactctccaagccagaagagagtgggggccaatatacaacattcttaaagaaaagaattttcaacccagaatttcatatccagccaaactaagcttcgtaagtgaaggagaaataaaatactttacagacaagtaaatattgagattttgtcaccaccaggcctgccttccaagaggtcctgaaggaagcactaaacatggaaaggaacaaccactaccagccactgcaaaaacatgccaaattgtaaagaccatcgaggctaggaagaaactgcatcaactaacaagcaaaataactggctaacatcataatgacaggatcaaattcacacataacaatattaaccttaaatgtaaatgggctaaatgctccatttaaaagtcacagactggcaaactggataaagagtcaagatccatcagtgtgccgtattcaggaggcccatctcatgtgcagagacacacataggctcaaaataaagggatggaggaagatctaccaaggaaatggaaaacaaaaaaaagcagggttgcaatcctagtctctgatgaaacagactttaaaccaacaaagaccaaaagagacaaagaaggccattgcataatggtaaagggatcaattcaacaagaagagctaactatcctaaatgtatatgcacccaatacaggagcacccagattcataaagcaagtccttagagacctacaaagagacttggactcccacacaataataataggacactttaacaccccactgtcaacattagacagatcaacaagacagaaagttaacaaggatatccaggaattgaactcagctctgcaccaggtagacctaatagacatctacagaactctccaccccaaatcaatagaatatacattcttctcagcagcacattacacttattccaaaattgaccacatagttggaaggaaaacactcctcagtaaatgtaaaagaacagaaatcacaacaaactgtctttcagaccacagtgcaatcgaactagaactcaggatcaagaaactcactcaaaaccgctcaactacatggaaactgaacaacctgctcctgaaggactactgggtacctaatgaaatgaaggcagatataaacatgttctttgaaaccaatgagaacaaagacacaacataccagaatctctgggacacatttaaagccgtgtgtagagggaaatttatagcactaaatgcccacaagagaaagaggaaagatctaaaattgacaccctaacatcacaattaaaagaactagagaagcaagagcaaacacattcaaaagctagcagaaggcaagaaataactaagattagagaagaactgaaggagatagagacataaaaaaaaaacccttcaaaaaatcaatgaatccatgagctggttttttgaaaagatcaacaaaatggatagactgctagcaagactaataaagaagaaaagagagaagaatcaaatagacgcaataaaaaatgataaaggggatatcaccaacaatcccacagaaatacaaactaccatcagagaatactataaacacgtctatgcaaataaactagaaaatctagaagaaatggaaaattcctggacacatacaccctcccaagactaaaccaggaagaagttgaatctctgaatagaccaataacaggctctgaaattgaggccataattaatcacctaccaaccaaaaaacgtccaggaccagatggattcacagccaaattctaccagaggtacaaagaggagctggtaccattccttctgaaactattccaattaatagataaagagggaatcctccctaactctttttatgaggccagcatcatcctgataccaaagctgggcagagacacaacaacaacaaaaaagagaattttagaccaatatccctgaagaacattgatgcaaaaatcctcaataaaatacgggcaaaccaaatccagcagcacatcaaaaagcttatccaccatgatcaagtcagcttcatccctgggatgcaaggctggttcaacatacacaaatcaataaatgtaatccatcataaaaacagaaccaaagacaaaaacaacatgattatctcaatagatgcagaaaaggcctttgacaaagttcaagagcacttcatgctaaaaactctcaataaactaagtattcatggggcgtacctcaaaacaataagagctatttatgacaaacccacagccaatatcatactgaatgggcaaaaactggaagcattccctttgaaaactggcacaagacagggatgccctctctcaccacttctattcaacatagtgttggaagatctggccaggacagtcaggcaggagaaagaaataaagggtattcaattaggaaaagaggaagtcaaattgtccctgtttgcagattacatgattgtatatttagaaaaccccatcgtctcagacccaaatctccttaagctgataagcaacttcagcaaagtctcaggacacaaaatcaatgtgcaaaaatcacaaacattcctatacaccaataacagacaaacagagagccaaatcatgagtaaactctcattcacaattgcttgaaagagaataaaatacctaggaatccaacttacaagggatgtgaaggacctcttcaaggagaacaacaaaccattgctcaacgaaataaaagaggatacaaacaaatggacgaacgttccatgctcatggataggaagaatcaatatcgtgaaaatggtcatactgcccaaggtaattgatagattcaatgccatccccatcaagctactgatgactttcttcacagaattggaaaaactactttaaaattcatatggaaccaaaatagagcctgcattgcaaggacaatcctaagccaaaagaacaaagctggaggcatcatgctacctgacttcaaactatactacaaggctatagcaaccaaaacagcatgatactggtaccaaaacagagatatagaccaatggaacagaacaaagccatcagaaataataccacacatctacaaccatctgttatttgacaaacctgacaaaaacaagaaatggggaaagggttccctatttaataaatggtgctgggaatactggctagccatacgtagaaagctgaaactggatcccttccttacaccttatacaaaaattaattcaagatggattaaagacttaaatgttagacctaaaaccataaaaactctagaagaaaacttaggcaataccattcaggacataggcatgggcaaggacttcatgactaaaacatcaaaagcaatggcaacaaaagccaaaattgacaaatgggatctaattaaactaaacagcttctgcacagcaaaagaaactaccatcagagtgaacaggcaacctacagaatgggagaaaatttttacaatctacccatctgacaaagggctaaatctagaatctacaaagaactcaaacaaatttacaagaaaaaatcatacaaccccatcaaaaagtgggcgaaggatattaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaaaatgtggagaaacaggaattcctttaccctgttggtgggactgtaaactagttcaaccattgtggaagacagtgtggcaattcctcaaggatctagaactagaaataccatttgatccagccatcccattactgggtatatacgcaaaggattataaaccatgctgctataaagacacatgcacacgtatatttattgtggcactattcacaatagcaaagacttggaaccaacccaaatgtccatcaatgatagactggattaagaaaatgtagcacatatacaccatggaatactatgcagccataaaaacggatgagtttcatgtcctttgtagggacatggatgaagctggaaaccatcattctcagcaaactatcgcaaggacggaaaaccaaacactgcatgttctcactcataggtgtgaattgaacaatgagaacacttggacacagggtggggaacatcgcccattggggcctggcatggggtgaggggaggagggagggatagcattaggagaaatacctaatgtaaatgatgagttaatgggtgcagcacaccaacatggcacatatatgtagatgtaacaaacctgcacattgtgcacatgtaccctagaacttaaggtataataaaaaaaataggcacaccaattcaaaagtcggatattgtcagactggattaaaacaagaataataaaaagatccagtcatatattttataagaaaaatactttaaatataattgtaccaagaagtcaaactggtaacagcaattaaaagaatgtgagggtgcgaggtcagatcgagaccatcctcgctaacacagtgaaaccctgtctctactaaaaatacaaaaaaaaaattagccgggcatggtggtgggcacctgtagtcccagctacctgggaggctgaggcaggagagtggcgtgaacctgggatgtggagtttgcagtgagccgagatcacgctgctgcactcccgcctgggtgacagagcgagactccatctcaaaaaaaaaaaaaaaaaagcatatgagggtgtatatagtaatattagctaaagtggatttcagcataaggaaaattaccaatgacaaaggcaaacaatataaagaccaaagggtcaattcattaagaagtaatagtaataccaaatttgcatggatctaacaacagaacttaaaattcttgaagaaaaacctaatataactgcaaagagaaataaccaaattcaaaactatacctatttatcttaattaataaaacaagtacacagaaaataagccagggtatataatatattatcaatattattaaacaacttaaaattatacccaacagttgcagaatacatattattttaaaatgtatgtagaacatttgtcaagataggtctcatctatgttaacataacagacttaaatttagaagaattgtaatcaataatagaaaattgtctataaagatcacaaagtatttggaaattaaacaacatacttgaaaataatttataagtcaaaaagaagtttcaggacaaattagcatctattttaaacttgattaatataaaaatgcaacataaaatgtgtaggatgcagctaattcagagttggggggaaaatttatagcattgaatgcttacattagaaaagaaaaaaattctcaaatcagtaacttaagctttcacattaataaactagaaactaagaagaaatgaaaaacaacacaaagagaaaaaaatgtgataataaagattaggctttaaaacaatgaaatttgaaggtagaaaataataaaattaatggaaccaaaagctacttctttgaaaagtttgataatttgataatattgaaaaacctttttccagatcaaccaaagaaaggaacagagggaaagccagaaagagagaaatagtgaacaaaaattaccaacatcagtaggaaagagggatattattacaaagcccatagctattcaatatataataaaatataagaggataagaagaaatattagggacaatttatgcctataagttcaacaacttatagtgaataaaccaatttattaagaaaaaaattaccaaatctctttctcactctctctctctctctctcacacacacacacacacacagagacacaaacacacacatacaaaatagatatcttcaatggtcctctatctgtaaaaccaattgagttggtagttaagtatcctccaagaaaattacaggcccaggtaattttgttggtcctgtaattctaagaataatttgtggaggaaattacagtaatcctacagaacctcttccagaaaattaaaaaaaagaagaaacatttgtcagtttattccctgaggccatcactgcttgaataccaaaatcagacaaagccactacaacaaataaaaagcacagaacaatatccctcatgaacatagatacaaatattttcaacaaaatataacatgttgttgcaattgcttctggggactaagcataatttatttgtcaataccaacaccaagaatgttatttcctaagttttcttccaggatttttagagtttgaggtcttacatttaaatctttaatcaatgttgagttaacttttgtatatggtgagatatagggatccattttaattcttctgcatatggctagccaattatcccagcaccatttattgaatagggaatcctctccctatcgggggaaattcagccagatattgggcaaaattcacccccgatatttcacgtaggttcttttctattttccctaagtgttggctggtctgagaaataaagggacagagtacaaaagagagaaattttaaagctgggtgtctgggggtgacatcacatgttggcaggttctgtgatgccccctgagccataaaaccagcaagtttttattagtgatttcaaaaggggagggggtgtatgaatagggtgtgggtcacagagatcatgtgcttcacaaggtaatagaatatcacaaaggcaaatggaggcagggtgagatcacaggaccacaggactggggcgaaattaaaattggtaatgaagtttcaggcatgcattgtcattgataacatcttatcaggagacagggcttgagagcagacaactggtctgaccaaaatttattaggtgggaatttcctcgtcctaatacgcctgggagcactacgggagactggggcttatttcatccctacagcttcgaccataaaagacggccgccccctgaagtggccatttcagaggtccaccctcagggatgcattctctttctcagggatgttccttgctgagaaaaagaattcagcaatatttttcccatttgcttttgaaagaagagaaatatggctctgttccgcccggctcaccggcggtcaaagtttaatgttatctctcttgttccctgaacattgctgttatcctgttcttttttcaaggtgcccagatttcatattgttcaaacacacatgctctacaaacaatttgtgcagttaatgcaatcatcacaggggcctgaggcaacatacatcctccccagcttacgaggatgacgggattaagagattaaagacaggcataggaaatcacaaggctattgattggggaagtgataagtgtccatgaaatcttcacattttatgttcagagattgcagtaaagacaagcataagaaattataaaagtattaatttggggaactaataaatgtccatgaaatcttcacaatccacattcttctgccttggcttcagctggtccctccgttcggggttcctgacttcccgcaacatttccccactgttttttttttttttttctctgaagatcaaatggttgtaggtgtgtggttttatttctgggtcctctattctgttctattggtcttgtttctgtttttgcaccagtaccacactgttttggttactgtcactggtaatgtgataccttgggctttgctgtttttgcttaggattgctttggctatttcagcactgttttagttccaaataaattttagaataggtttttctagttctgtggaaaatgccattggtattttgatagggataacattgaatctgtaaattgctttgggcagtatggccattttaacaatattgattcttccaatccatgagcatgaaatgtttttccatttatttttttcatctatgatttctttcagcagtgttttgtacttgtccttgtagagcagtttcacatccttgattagatgaattcccaggtatttcattttgtgtgcgtgtggctattgtaaatgggattgtgttcttgatttggctgtcagctagaatgttactggtgtatagaaatgttactgattttgtacattgattttgcatcctgaaactttactcaattagcttatcagttccaggagcagagtttttaaggtttctatgtatagaatcatatcatcattaaagagagaaattttgacttcgtcttttcctatttgtatgccttttatttctttcttttgcctgattgctttggctaggacttttggtactatgttgaaggaaatggttctgtaggtcactatcctaagcaaataaatgcaagaacaggaaaccaaaaacctatgttctcagttgtaagtgggagctaaacattgggtactcatggacataaagatggcaacaacagacactggggactactaggaggaggagagtggaagggggcaaggattgaaaaagtacttattgcatactatgctcactacccggatgacgaaatcatttatactccaaacctgagcatcacataatatacacacctaacaaatctgcacatgtagcctttaatgtataataaagttgaaatttttgtttaaaaattagcacattagatccagcaataatccagtaatgcaaagataattcactatttgaaaataatttaatgaaactttcctagtagcagactaaaggagaaacaacacattatcttaataatagatgcagataaagtatttgaaacaattaaaaatgtatttataaaaattaacttctcagcaatttaggaatataatgaaccactttaatatgataaatagcatctacaaaagtcctacagctggcatcatatttgaaagtgttaaaagtaacaccacaaaactacttcaaaaaataaagtgaaagtatatttttataaccttggttatagagtaactgacagagcaggagcactgtcatctcagacaaacaccaccactttaagttccagctccctttctagcctcatgcatttcaaggaaatcacttctgtcctaactacaagcagaaagggcagatagtaaaacacagataagatagcttgagcacaaaaggaagtgggggtaaagtttcttgggtaactgccaaacttcaccctcataaaatgggccccagaaaacagtgggcctcaatagcacattccttacccttcaggtccgctaagataggaaagctaaaagcagaatccagtgttggggagtatgccagcagctgcaggaagatgtttgggaacacacaactctccctcccagataagcacaacaaacagaaacagaagcagtccaagcctccgctgaatgcttcaaccctgaatccttaaaaactcttagtctggaccaggcatggtggctcacaccggtaatcccagcactttgggaggctgaggtgggtggatcacaaggtcaggagatggagaccatcctcactaacacggtgaaacctcgcctctactaaaaatacaaaaaattagctgggcgtggtggcaggtgcctgtagtcccagctcatcaggaggctgaggcaggagaatggcgtgaatcctggaggcagagcttgcagtgaagccaagattgcgccactgcactccagcctaggcgacagagcgagactccgtctcaaaaaaacaaacaaacaaacaaacaaacaaaaaacaacaacaacaaaaaaaacaactcttaaactcttagtctctaagagagtgggctccgacctaacatggccagaagcgcctctcaggtttgttttctctaaaataaacctatccttcactgtcgaaccacctttcacatttctttcccctttctttaattcttacagtatctttttaaatgataattattaactcaaattataacattaaaactacggaaatttgctaaaataaaaataaagttttgttttcttagttgtgttctttgtcttagaagacaaagttaatatggggtaaattaggaaaatacttaaaatatctggaattgtcaagaatatgatatctaaaatatgtgataatatgcatatcaacaatgaaaaggaaaacaaaaactaggcttactattaattgctattcacagaaagaaatgcctgtctagctagggagtgtaatttaaatgagaaattttagtcatgttaaatgtttgttgattttatctttcagcatactaactcagtttcagtaatttttttctattgattttcttttctctattttatttctgctttgatctttgttattttctcacttccgtcacctttaggcttgatttttttatttttgtgtttctttgtgctataattttagtttgtttatttgaggtcttttgtctttttttaatgtaggtgattatcactataaacttccatcttagcactgcttttgctacatctcataagattcagtgtgttgcatttttttgtttgtttctagacattttccagtttccattatgatttattttttgagccaatgattgttcaaaggcatgttatttgtgtgaatttgtaaattaaaaaattctttctcttcttattgatttctagtttcattccaccgtggtcaggaaatgtacttggaatgatttcaatattcttaaatttattaaaagttattttgtgacttagcatgtgatctatcctaaagaatattccatgtgctcttgaaaagaaaatagattctgctgctattgggtggaatttctatatatgctcatttcttctatagtgctgttcaagtctgctgtttccttattgattttctgcctgatatgtctattattgtaagtggggtattgaagtttcctactagtattgtattgtctatttattatttcagacgtcaatatttgctttatctattgagatactttgatgttggatgcatgcatatttagaatattatacatttcttttgaattgccatttttattattatgtaatatctttcaccaacattttttacttaatgtctactttgtctgatataagtttagccatgccttctctcatttaattttccattgcatggaatatccttttccatcctttccttttcagcctatatatttacttaaatctaatgtgagtctcttatagacagcatatagtgggatcttttaaaatatcatatctttaatttgttagtttatttacatttatggtaattatggaactgtaagaacttactattgccattttgttgtttttgtgtctttttgtaattttttcctctctttttcttttgctgtcttcttttgtgttttgataattttctgtagtgatattctttcatttttcttcctttatgtcatttttatatctgatataggtttttctagtgtggttaacatggggcttgtataaaattgcttatagttataacagtcttctcagctattaacaacttcaatcacatgcagtaattctgcacttttactttctccacatacactatgctattgaggtcagaatttatttttttaattgtgcagccattaatcatttttatggttattgttattatcctttttcaacagcattgacaaactacaaaatagaattacataatgcattgcttttttattgttgatttaaaaaggcaaaaatatctgcctttgaaattcaagtgccacctcttttaaatcttcaatagacaatttatatgtatagcattttatgctgtttaattcattttgtaaatgcagatttagtactattttctctgattccagctgactagattgtgattaggtattctggattttacttaatagcttcttccttttctatttttttagtcctaacttacatatttttagttcattattattttgttttccctattttgcatttagaaaataaaagaggcatataccatatataaataactattttatctgaaaggaggtgaattgggaaatcaacaagaaaattttctgcttattcaaaagcgattattgagccttagtaccaactttgtaacatttacctcactagaaatgaggtgcagctcatagttaaaagtgaaggactcataatatagtgtactaaatgttagagtaaatatacattatgaaatggaaaaatagagtattttattcagacaaggagtgaaagggaagtctcctaccaggaagtgatacttccactgaaactggaaagataaatagatatcttcagcatgagaaaacagcgtgtgcaaaatatcaagaagtgagtatatacgatgtatgagaaaaatacaagcatgttgatatagcactagtatggaaaaacttgcctggtgatgagactgaatgagctttcagatataagaagttaccagagcttaaatatcttttttattctactaaggaagttgaatatcctttggaaaacagtagaaaagtatagataggtgctaacaaaggaaataaccggaatagatttaccgatttaaaagattgttacgaaagcaaaactgaataatgaaggcaaaatgctatgaatgtttcttatcacacaataaagtagctctactgctcctgagtaacttgttttcctatttgcctttttttcttcccctatttaatccccaaaagttcaatatgtatgcataatttcccgaaagtaatttcaatagtattgactatgtcctatgacaagcattgaaatactaagctaagcactagaaatacacacataaataaggctgcatcacagcccttaaaaatttgctcctttagtgggatggcagaggggtgaggggtggccctttcaataccatatcaagatgattttataccattatgcataggttgctatatgtataggagcagagaggctgcaagtttagataagttgattgagaaaatatttctttcaggaaataaaattcatactgagtcttacaagattaataaaattgtaaaaggtgctcacatgccttgggttagtattatttattgctccagctaaagaggactaaatattcgaaaattcctcttcctttccttcttgcctttcattcccagcatcctatatcttattagtcaccaagactttctgtctattggtgtgcattgtgaagggagaaagctttaactcagtcatttctctcaaattctgctcttcatttccttcccactctttagttcctcaccatctctcacttaaacttttgtaattacttcaccctaggacaatcaatcttccatactgctgctaaagggatctttccaaaagataaatttgctcttatgattcccttgataaaaaaatgaaacaccaatgaaagtgttcagcaattttccactgccttcagggagaatctcaaaaccctaagccagtggtagaacacccctcactaggtaacagtgactggcctcatgtgttttcatgctgtcttttcctttaaatttttaaaaaatatgttcctgtttataaagcctccctccctatcccataggcagaagtagctaggaccctgacttagagcacttttctctttgaatgaaattacttttataatttctagactgtgtttcacttctagactgtgaacatctgaagttgggaaatgcattttatttatctttgattcctcaatacttggccaaattcctggttcagttcttattatattgaaagtatgaaatacattttaaagtaaattaaataaaaataaatcaactcagagttgagaaaaagacctggaagttaggtaatataataagtcatgaaataaacactttcctggaaataaaaaatgtgaagaattttcctggaggatacttctacatttaagtattcaacatttgcctttgggtacttcaaagttaatgaagatttttttttcaagtccataagatgaattttagaaaataaatttcaaaaaatatactatatcaaataaaattttatgtatagtaatcatattattaggcttttaaaagtgtcagtttaattcaaatcagagtattggatgtttgcatagctaaccatttatttgaattcagaatatagcagttcatgtgttttattatttttaatatgacatcaagacactccagggcacattttattattccatttattcatgcctagggtatattatgagctgcaaacctaaaggctaagtactttaaccacccgaatcatgtattagtggatcaataaaacacaccctggagtatcttaattctataatatgtctcctatttcttattaaaaaggaaaaaagcaattaatctagaacaaaactaatactttaaaatcacataattctattgttacatattttatacaaggtacaaaggaaaaacaatggcagttatttgttaggatattactagggaaatgatgaattatgcagttcatcttctgaaataataaaaagtatttctgctttaaaagcttttatggatatactgcccaagtctatgtgaagtattatatattcagaaccggtaattccttatggtagtggcaatctaaaaacaaaggaactagacaatgtaatgttgcatttaattaaatatatttggtaaactgcaacttgccatgtatttaatacaattttatattcaattgcaatagcttgcatcagctacaatttcttagtatagctttttcatttgttctgtgtttagtattttgtctaaacacttttgtcactagatttgtcacacccaaactatcaattgacacattgtagatgctcaacaagtatatagtttaaataaaagtataattatattgttaaaccacctcaaattccattttggaagtaattgaattgaatataataaataaaattaattataaataattacatatatgaataatcatttataaaattataacaaaaggcaaaagaaggcaacaattatttatataacttcagatattaatagtattttgatatattaactcatttaatttttataggagcactataaacaaaaccttactatactctcacaagtgagaagtctgaagctaagagatattaactgcgttcctcatcttggtaactgatagggttaagatttaaaaggaaacagatccagaatctgtttgattacaaatgctattttatttttactgtaacatttcaaaactaaatatgctcaaccctttaaactttgtttaacaaaactgatccatctttcatcattcagagatcagtcttgggactgaccctattgtaaacatttatcatgattgcacagtactgtagacaatgagagtatagcaaagtgaaactgtccagacagaatttatatcatccttacaatatgtacctcatattgtatttttcttgtctttatttttccccaaatacttacagcaaaaatcatttgtttaaacattagataagtagataaacagtatcccagagcagattaaagaagaaatgtttaataattctgtatatatttttccagtctaaatattgattatagggaaatgggaactgccatcacaaaagaaaatagttttttttttttttgatgtagcatagttctttgttactactgcattaacaaaccatagcagagcagatatgaatagctgcgaaacacagtgaaggggtcaataggcaaaagacttgaactaaggttgtttagtgggcaatatccattgaacaccaccaccaaaattgttgttttctcattctgcttccttctgccccacagtccattcatcttcttttaacatcttgctcttaatttattcagtgaaatgctcacattaacaaccactgctgtatacagctgtaactttcattcttacatttaccaaatatactttgaatgtgtactaagtttcaagcattgtgttaggtccttatgacacaggaagtcctgagccctacctgcagaacctatctcaaagtctagagaatcgagatgtttgtaggttatttagcctatctaatggcttctctgtggaaaatggtagaaaagtcatgagcaaaaacagacatgaaaaaaatgagagatgtgtttagctgtagtgcaagtatcatcagtgtgagctgagaatgaacaatatattgaagcaggattacagattatttaagtttcaagcaaaggatttcaacaaatgatactgaaacactgaaggaagttgatttctgaaaaagtatgttgaaagtgatagttagaaagaataactttgtgactgtacccaatgcaaaatatctagtactcaagtgacttttattttttgtacatctaatcggtgtcaggcacagtgctatgctacaaagacaacagagactttgcaatcactgaagaaactattatattctttgatgagttttcacggttataccaacaacaatttattaaatacttactatggcaatcaatatattaaatttggcagtgtaaggattatattccttataggcatcttacaagatgtttacaatttattccatttttaaaaatgagaaaattaggttcagttaagcaatttgccaagctgagatcagaaataaggcatttctggatccacagcttatgcttcaccatgcacttggccttcaagaagaaaatgaagcattccttcagattttgtggaggagtttctgcttaacagcatatttattgaaggcttactacaattactggaaacatcaattattaagtctactaaagacaaaactaatttcgtagtttaggcaagaaccagtaaggcctgctttgctggtgtagtaacatttctatttcagtctttcagaaagatacactagatcttatgaacaaataatctccaggacatgataactgaggaggaaatgatcatattttttcatgctaggaatggtaatccacttcttttgccaacactttcttatgtttagcactccctactgtcagaatattcccccttcagctaaagtaaattcgtttgttactctttgtcactcaattatgatttctcatgaataaaatttaaaaaaacagtgagtgttggcctatttaagagaaaaaaacccagtatttctaagcctcctttttcaagcagttttgcatcttgaaagagatatagaaataggaaatacaaaagaatagttcactcaaggttttgtatttaccactggaaataatagtagagaaagaatggagaaattacatggagattctatgcaaaaaattctctgttgtgttgttactgaactgtagggaaaatcattttcagatcatctcaaaaatataaaaatgtgaaaagaaaataaggtatggttagacatgctgtctactaatattaggtttattgtaattggtcttaatcatctaaggtttatttttttttctttatagttaacctaatcaatctgtttcttaaagttttggaatttttagagaaggaaaaagaggaatttgtataagcataaataaatatttgacaaattcttccaaactaggatacatcattttaggtactttacagaaccagattatttgtatacctgtatatagttatttatttttctactttcaaatattaatttttagaagttaaactaaatcataaaataagaagtttacaacaataaataaataagccctgaagcaaaaggaaactcaagattgtcattaacaatgagaacactaacaatgagaacaatgaatatcaaaatctttggaatgtgtttcactagtaaaataataaatatacctctagcaatgctacttaaaaatggagagactatacaacgcataatattttaaagtgggagagataaatatagattaatggaaaatatggaaagtcaatgatcataaccatctattataatgtttgcatttaaatcattgcaaatagattgaacgttaaggtaaattgtttggagagcactatataattgttttggaaataattatttgtctacattacactcaaatttgcaaatggatagttaaattgaaaaaatgaggctgtagggtggctcatgcctataatcccagcagtctgggaggccaaggagggcagatggcttgagtccaggagttcaagccagcctgagagacatggagataacacatgtcaaaaaaaaaaaaaaaaaaaaagagccgggtgttgtggtgcatgcctgtagtaccagcagctacccagcaggctcaaagcctggaggcaaaggttgcagtaagtgagctgagatccaaccaccgcactccagcctgggtgacagaatgagaccctgtctcaaaaaaccaaaaataaataaatttgaaaaatgaaacaaaaagattattgtgtatatacatatatatatgaaatacaattttttagtcagaatgtaaagacatttctgtacattgctatattttcctgtgcctagaacaatatattagaatcccaatgaatatttggtgaatgactaaatgggagaggctttattatttatggtaaatacaaacaaaaattaggtcacatgacaagacaaaaataggaggaataaacataaatttagaaccataagaaaacataagtatttaacaaaaatcatcattaactcaataggaaaaatataaataagcaggacttaaggggtaaagtgatgacactcccctccccatgtacgtacctacatcaaagagcaagaaagagagagagagacagagagagagagacagagagagagagacagagagagagagagagagagagagacagagagagagagagagagagagaggagaaaaagagaaagagagctgttgagattgagattgaaaggagagatacatctttaagttgttgacactagtggaattaatgtactttattcttctcttcaaccttcattttcatatttttctacatttcattatataattatttttgttaaaagaaacaaaaatattatttcctgtggttaggcatttgctttttttttttttttttgacatggagtttcgctcttgttgcccaggctagagtgcaatggcacgatctccgctcactgcaacctccacctcctaggtttaagcgattctcctgcctcagactctgagtagctgggattacaggcattcgccaccacgcctggctaattttgtatttttagtagagataggatttctctatcttggtcaggctggtctccaactcccgacctcaggttatccgcccacctcagcatcccaaagtgctgggattacaggcgtgagccactgcacccggctggcatttacattattaaccacaaaaatcttactgcttttttcctattattttaaaatgaaatggtaatcaacagtgatagcaagtagtctttaactcaaaaccaacatatttgtcagggcatttactattacacagaatagcagcatatatgttgtgttcaatgctttaatcccaacaatgaactattaaataatgacttgcgctcttaacgatgttttaattttaacagtgacacacttaagaatatacttagactttttcatccctttgattttttcaccaaagatcaataatgatttaatattttccttttctacatatttttaatgttgtacaatataaaaacataaaatttgccatcttaacagtttttaagtatgcaattcagtgatatgactacactcacattgttgtgcaagcatcatcactacccatcttgagaacttttctcagctttccaaactgaaatcctatactcatggaacagtaactctccattctccccttccctggccccaagtccctggcaaccaccattctacttgctgtctctatgaacttgattaatatagatactttatataagttgaatcatataatatttgcccctttgtgactggtttatttcacattgcataatctcatcaatattcaaccatgtggtattatgtgtcagaatttccttcctttttaaagttgaatgatattccactgtgtgtatataccacatttatccactcatctgttaatagatattttgcttgcttccacctttcagctattgtgaataatgttgctatgaaaatgggtgtacaaatggctcttcaagatcccattttcaatgatttggggtatatacccagagtgaaattgttggactatatggcaattctatttttaattttttttgaggaactactaaaggagtattaattattactgttatctggttatatgaatgaccacagtgtgttggtatttacatgggacttgaatttggagtcaaaaaataaggatgtgatttttcgtttttccttagctaattcataagaatctctagacatttgacttgtataataaggtggaacaatataagcaatatgacttaaagtttgtaaattcatatccgtgagttttagatttggtggaggaaagaaaaaaagagcaaacacgatgacttcattttaacattattttatccaagaatcatgagcttaaaggactggggataagcagttctcttaatgttaatgaggaagacacagaaataatgacctacagaaagtttgaattatagagatccgaattcaatatgatttatttacagggttttccctagaagaaaatgtgaagtataagattagcaagaagatgagtaaatcaatctcacgatactaatctagaaataatcttcaattacttggaacttgaagtcatgttggctgacgaagttgcaaggtaacagtcttaaaatgaagtcccaggaagtatctaaggatccagactagagaagtttacaaaagttacagtgaggccagaaggagttctgctatcttttgcctggtggctatatagatttagaaccaatattggagctcttagaatcaacctgcttgatttgaatctgaactctatcttttgccaaaaatgtatatctaaacatcatattgtattccataaatatatacaataattatttgtccattaaaaatacaattgaacaatatcttaggcaagtagtataaccttaaggttctcagcttatttatttttaaaatattggtaatactcatatttaccttataaatttgtggaaaagttacatgaataaatacatgtaaaatgtttagaacaatgcctagttgagagtgttgcataaatacaagctatcaccattacttgactaaaatatagtcatagttgtcctctctcccatgtggacgaaaatgcttctttattattttaatcatcgttttgctgctgttgaatatattggctaaaaattgaaattaggcattttatataatagagcctatgaatatttattccaacttctgccttgatagttgaacaggtttgtctctgaaaatagcatcatgcagtaaagtttatattatttgcactaaacactgttgccacctctttctggcaaaggttatttgggagcagggaatgtgtctgactgattcatgattatatatctactgcttagaacggtacatggcacacagcattagataaatatttgaccagtgaatgagcaaaggaaaaaaactgtttactcttagtattctaattacattctatataaaacaatactttttttagaaaaagtttaatatagataacaattaattaaaattatactttcagtcataatctaaggcttgctcgtttctattacaaatttcaataatcttatatctgctcttttatctttttcctattttgtcattcttcaatccaaaattttgttttatcctgagttagaataagtgttcttgttaaaggtattcatctaacatctcaaagtaaactcataatcaaataagtgattcacagcatagaaaaatttgtggggattcataagtgggtgttgtataggagaggctaataaagccaagcattattctaacctttcactctatgaattttaagtgtggcgatatcctaggtattattttctgggccaaagactagaaatgagtaggactagtacaattatttcttatatgagtcatttttttatgataacattgactaatgtgctgtaacactgaatacgtttaaattggttctgcttaataatacttgatctacatcacaatacacattctttctacagagtgaaaagaaatgctaagaatcagagccactacaaaaggcttcacactgacattaaaaataacattaaaaaattgaaaaaaattcaccaaatttctgaaaggctgttttatccagcttctctttcttttggttaaatagacttattctcttaataatccttaacagaaaaaactgaatttgccacttcgtggtgttaaatattgactgtgaccatgccatacattataacattgcttgtatgccagaaataaaaaaaaaattaatgctggaataaattaatgattatgatgacttcgtttggtagaaagtaaaccagacaaggacatagattgtttctgtcataatcagtgctgtctcttccatgcctaaaagaatgaatacgtgaaaaatcatgattagatcaaaattcaacattacacaacatacctactaagccctttgtgtgtatcatttcatttagtcttcatgagaacacaataaggaggaagccaatcacaatccagagagacataatccataaaacctacattttattcaaaaatatgcagtttttgaagatgctttaacaaggagattggctaacaatcccaagcccataatcccaaatgttgaaatcccaaaagatcaaaatgcctaacgtctaaaatcttgaaaatataattcaggaaaaaataattttaaatgttcttaaaagacatttatttcctcttttgaaagggaatttctttgagaagtatatgaaaatatgagaaaacacttcataggccaatttatacaataaaataggcaagaatagcatacatgtttttgcaagcataaacacccagacatagaaactgacagtttaacaggtacaacagttatgagcaggtgaacagtattcattaagagaaagctcaaaaagtgaaatataaaaaagcataccactatagttggaatcatgtgtacccagctttataatggtgttcatttgtcacgtggctgtcaacttgagatttttgacaggatagattaaaaaaaccaaaaggggttactgcagtatatgcagtcaccaaaagagctgggatctcaagatcacaaattcagatttagagaaaaaagacatatcttcatttattgtgaaagttccaatgttttcacatttagaatctgagaagctgatggtgtaactttcagtttgagtctgaaagccttacgacccggggaggtctctggtgcaagtcctagagtccaaaggcctgtgagcctggggttctgaagtccaaggaagcagaggaaaaatctatctcaactctcagaaacagaccaattcaccttctgtagagactgtgcctgccaacagtgagggcagatctttcccacctaataccttcagactcacacactagtctctggaaatatcttcacagacacacacacaaaaatgctttaccaagtttttaggtattcgttaatccaatcaaactgacacataaaattgttcataaatccattccttatcaattaggcatctgatatggtttggctgtgtccccacccaaatctcatcttgaattcccatgtgttgtgggagggacctggtgggaggtaattgagtcacgggggcaggtctttcctgtgctgttctcgtaatagtgaataagtctcatgagatctgataggtttaaaaatgggagtctccctgcacaagccattttctcttgtctaccaccatgtgagacatgcctttcaccttctgccatggttgtgaggcctccccagccatgtggaactgtaactccattaaatctccttcttttgtaaattgcccaatcttgggtatgtctttatcccgaaaatgtggaagcgactttggaactgggtaataggcagaggttggaacagtttggagggctcagaagaatacaagaaaatgtgggaacatttggaactcctgagagacttgttgaatggcattgaccaaaatgctgataaagatacagacaatgaaatccaggctgaagtggtctcagatggagatgaggaacttgttgggaactagagcaaaggtgattcctgttatattttagcaaagagactggtggcattgtgcccctgcactagagatttgtggaatgttgaactagagaaagatgatttagggtatctggcagaagaaatttctaagcagaaaagcattcaagaggtgacttgggtgctgttaaatgcattcagttttaaaagggaagcagagcataaaagttcaaaaaatttgcagcctgacaatgcaatagaaaagaaaatcagattttttgaggaaaaattcaagctgactgcagaaatttgcataagtaacgaggatgttaatcataaagacaatgggaaaatgtctccagggcatgtcagagacttcaatggcagcccctcccttcacaggcccaggggtttaggaggaaaaatatggtttcatgggccgggcccagggtccccgtgctgtgtgcagtctagggacttggtgccctgcatcctagctgctccagccagggctgaaaggggcagacatagagcttgggccatggcttcagaaggtataagccccaagccttagaagtttccatgggattttgagctgtgagtgtacagaagtcatgaattggggtttgggagcctttggcttgatttcagatttatggaaatgcctgaatggccaggcagaagtttgctgcaggggcaaagccctcatggagaatctctgccagggcagtgcaaaagagaaatgtggggtcagaacccccacacagagtgcctactggggcaccacctcctggagctgtgagaagaggaccaccatcctttagacctcagaatggtagatccactgacagcctgcattgggtttcttgaaaagctacagacattcaatgccagctcatgaagcagccaggagaggggttatactctgcaaagccatagaggtagagctgcccaaggcagtgggagcccatcccctgcatcagcgtgacctggacatgaggcatgaagtcaaaggagatcattttggagcttgaagatttgactgcccttggccaggcacagtggctcacgcctgtaatcccagcactttgggaggccaaggtgggcagatcacctgaggtcaagagatcgagaccatcctggccaacatggtgaaaccccatctctactaaaaatacaaaaattatctgggcgtggtggcatgcacctgtagtcctagctacttgggaggctgaggcaggagaatcgcttgaacctggggatggaggttgcagtgagccaagatcacgccgctgcactccagactggtgacagagcgacacttcgtctcaaaaaaaaaaaaaaaaaaaaaaaaaaacagaaagaaatatttgactgcccttgaattttggtttgcatgaggcctgtagcccctttattttggccaatttctcccatttggaacaactgtatttacccaatgcctgtatcctcattgtatccagaaagtaactaacttggttttgattttacaggctgataggcagaattgacttgccttgtctcagatgaaactttggaatgtagacttttaagttaatgctgaaatgagttaagacttttgggggattgttgggaaggcacgactggttttgaaatgtgaggacatgagatttgagaggggccaggggcagaatgatattgtttggctgtgccccactcagatcttatcttgaattcccatgtgttgtgggagggatctggtgggaggtaattaaatcatggggcaggtctttcccatgctgttctaatgatagtgaataagtctcatgagatctgatggttttaaaaacagaagtctccctcacaagctctcttctcttatctgctgccatgtgagacgtgtcttttaccttctgccattattgtgaggtcttcccagccacgtggaactgtaagtccatttaatctatttcttttgtaaattgcccagtctcaggtatgtttttatcagcagtgtgaaaactgactaatacagtactcacatgcatctcctaaaaccatacttaatttccatatgaagatgataacaaggtaatatttctacctaagatgagacaactatcctgtgattgtaatttgcaggattttagacattagggatttttgacagtggaaatatagactttagagattttcatctttagggacactgattgttcaggatttcaatatttgggataatggtgttcaggattgtgactttgggattatgatcccagccccagtaaggcagggcttatcattattaacgtaatgtgagacttaaagaagataaaatatcttgcccaaacgcattagtatttgatacagcaagaaaaacatctaaattgtgaaaatattcattcttccgttgggagaataacctttatttgttttcctttattcaatgtttgttaaaaaataacaaaatatttatgtattctcatttcctttttgtatcagaaacatcaaggtgtgagccacattaactgaatgatatagaactagctttctgtttaacgtccagtaatctgggcaggacagagtctcacactctgtgtaagttcgtatcttctactccctcttcagatggcctctttcttgccgttcatcaccagctactcctctgctcctttgccactatggatacttaagctgttaaccattttacttaggtagctgttctctttcagatggttaatttctactaatttctgacctacttaatttctcctaacccccatctttgcctagattcattcaaatagcagtttttcccctactaaaaagaatattttgaaagttaatgttaccatttaaaattcaactaaaaaaatgattgaactcagtgtagtttcctacagtattccccagcatgacagtattcctcacacagtaggtgctcaataaacacttgctgaaacaataaatctgactgagttacataattttttaattggcaactgacatgctctcacaaacaaattaaaacaagaataagataaaataatttataataataagaataatatatgcatatcatttcatctgggcctttttcatactagaatattttccatgaggataaatcctattcctcttagctcttaaattgtagctttcaaatctacgtatatactcttttattattaaatgtcatttatatcaggctctgttcatgtcatgccataaggagtgcaactcctcccctccaactagatgtcagagaaagaaaagaaaatattagcctgaaattttgttgcttaatgtctttcaatgcctcctcagctgtctgtaagataaaatcgaatggcctatgcatagcatgtatgaccttttgtggtccaagcctgtcttgtcagcctcatctcttgctacttaccacaaagtgcactacacttcagccacagaaaattacttaaaatgcaccatgggattgatgaagttgagcctgttcaactgttgctcttcctgccagtatgctgtgttgtctaccaacacctgtctcactggttcttttcattcatttcagtttcctccacactgctcaaattaaattcagataatacctcctcacggtaccctttctgtcttccagctgtgactaagatgtgtgtcttctgtgctccctctcaatcttatacaaatgttaccattattcttattcatcagtaattattttttattttttatttatttattttttttgagacggagtctcgctctgtcacccaggctggagtgcagtggcaagatctcggctcactgcaacctccgcctcccggattcacgccattctcctgcctcatcctcctgagtagctgggactacaggtgcccaccaccacgtctggctaattttttgtatttttagtagagacggggtttcactgtgttagccaggatggtcttgatctcctaacttcgtgatccacccgcctcggcctcccaaagtgctgggattacaggtgtgagccaggtaattatttttgagattcaactatgttcaaggcactgtgatagttccagggaatgcagatgatacagtgccaaacaaaacagatgcctacatcaccagtctttacagagaagagtagtgtgtttgcttacctcctcccactagacaatgaatacctaaaaaaatggggcctgcctctgatttctatgttcccaatcactggtacctcatagacaggaagtgctcactgatgaataagcttcccttgtcttatatggagaagtcttggaccgttaatattcaggacttcacaatcacagttgaaacatatcttattttgaaagattaccccagtggcacgttggaaaacagaattgtatacatagcttatttgccttcatttcaattacattatttctgcctatttcaatgcttgtttcacattgtgatcgaaagtaaaatgataagaaattgtttacattcaaacaagttaatattttggactactactttcaatagaaaaaaatattatggaataaggttgataataattaaaggatctcagtggactttagtggaatattactgaaagttgaatttcatttttatatatacaatatcttgatagaaattgtctcttcttctatttgacttgttaactacatggcacaaatatattcatgcaaagttcaatttagctattgtgtttgcatagctgactaataacacatatcactttaaataaattttctctcagaagtctaagctaccaattgaataaaatttgaagcaagttgcatagttggaatttgccatatgtattccttattttctataaattggcttaaatattgtcataattttatgaatattacatatctaatgtcaacatttcagacactgtaataagtctttcttctaacagactcctccaaatacaaagtgtacatagttgtctgaattaattcctttatgtcttcatgaatttcccagtgatcctgagcccacagcaatgaaaattttactgcatacttacttactagtcctaatctctcagagacaatgattatgccacttctaacttctagattcatgtataatatttgatattgtaaataacatcaatattcatcctctgttttctattattgctatataaatatatacatatatgtttatatgtgtgtatttcacagatgtgtaatatcagtgttattattatcaatctagaattgaaaacagaatttttacaaagcattcatttttctgtacaaaatattatggaaatatatatgcttggattatttatatgtttgcaatatttacttataataaattcataagctaaacatgaagaactgctgagggaggaagcatagtaaaagtgtatttaaacaatgttcaatggcattatttataaatgttgtcaatcggttattttatctagaatgtgcaataaaatgggaaaatattaagttaatggattcaataacaagcccattattactgaagctgtagtatgacttctgtagccctaaagattatagctgagcagcagaaggggaaaaaagtagatcatccattacattgagcagttaatgatattttattgcattatttatcaaatactgtggatgttatttgtagctgcaagcttgaccttagctaatcataatttgatgaatgtgtatatctgaaaggcactatgacaaaatactctattgttttatgaagcaggaacatgagctagtattatgaaattcagtaagtgtgtagtttcaagatattaatgctcagacacttatgcacaagacagaatagatgcttgtaattcagacatggctgctgaaatgtctttctcttttaataatataaatattcaagccatctatcttaactgattcctgcaaagccattttataaatgcagtaagaagactataatgataatatattattaatagaatagagttctcattctatcaggaagatgtgaagaaaattagaagcttttcgcagtgttatttaggagtttgtatttagttggatttcaaatatacatattttggagagaaaatataaaagtgataaacaagtaccaactgcataatttttaactttatcagtcttctaggaaaggaaatgcattataatttccaagatgagaacaatattttattttgtacaatttttttaaggttggaatgagaagttagctcattagaacttcttttcatatgtaaagaagcattgataacaatgaagaaatattttgaaccaataatataacttgtaaagcatttcttggatattgaatcatgcaacttaatttacacataggccaattaaatttatcacagaaggagataaataaaactaaataagaactgcctctaaactaagtaaactaagagatattcccactgaagcaaactgcctatcaatgacacttgatcaataaacacttcagcgttttttgttttttttttttttttttttttttagacagagtcttgctcttgttgcccaggctggagtgcagtggtatgatcttggctcactgcaacctctgactcctgggttcaagctattcttctgcctcagcttcctgagtagctgggattacaggcaccagccaccatgcctggctaatttttttgtatttttagtaaagacatggtttcaccatgttggccaggctggtcttgaagtcctgacctcaggtgatccgcttgcctcggcctcccaaagtgctgagattacaggcctgaaccaccactcctggccagtttcattcttgagcatagtttttttcttctagtatatgtaaagaacttgtaaattttattttattttttaacttttaagttcactggtgcaagtgcagatttgttagataggtaaacttgtcacaggggtttgttgtacagattatttcatcacccaggtattaagcctagtacccactagttatttttccatatcttctccgtcctcccattctgcaccctctggaaggccccattgtgtgttgttttcctctacgtgtccatgtgttgtcatcatttagctcacacttataagtgagaacatgcagtatttggttttctgttcctgtgctgtttgcaaaggaaaatggcctctagctccattcatgtccctggaaaggacatgatgtcattcttttttatggctgcatagtattccatggtctatatgtaccacattttctttattcattctaacattgatggggtatttaggttgattccatgtttttgctattgtgaattgtgctcagtgaacatatgtgtgcatgagtctttatgataaaatgatttatattcctttgggtatgtacccataatgggattgttgggtcaaatggtatttctgtctttaggtctttgaggaattgccaaactgtcttccacaataactgaactaatttaccctaacagtgtataaccagaacttgtaaattataaggtgaatctcactgaaactactgggtgtaagtatcaaattattatgttttacagtatgttatatctaatgctgaaggttcttttccaaatgtggatgtcaaaattttacattatttcaaaattattctatgtgataaactgaattattgtttcatgaatgttaaggatttcttttctctctcggggatacagcatatttcaccgtaacaatgcctttgcatgtggttatgatatttgttttgtctatatgatagaacagaaaagtatagaagtcttaaatgtatttgtataatttgattttggttatgtgctcctgggatcctttcttagagagcatgcactttttaacaacattacattcagccagtttccagagtgaaactcatgattcagctgaccttgattcaactgaggattccagaaacaagcccggttgacccacagcttataggggaaacactaagctgattccaaaagagctcagaagagacactgttgactcacagccctgtgagttttgttgtaagccacagactttgaggtggtttgtaatacaacactattgttgtataaatcataaatacacatatgagtttctggagtactattgttaagaaactctcttattttgttacgtaccatagttaagaaacaaattttatttattatcatattaaattcatatgtttccagtctaatattttgtatatcactgttggatagagacttagtaactgaaatctagtctgggaaaatatttatggaaaataaataagtcatagcagaaatactttatatgatatttaaaattcattcaacatttaaaagaaaataatataatcctgtgtacttatcaattcactttgcaaaagacaatacatttgagaagaaacttaaaatcatactattcagacatatgaatcacattgctggagaaagagcaaacattcagaatgccagtttcatcccaaaatttgaatcacaaacaaataaagacttttgaaaaaaatctggtgaccagtagtcgcaaccttttctttatcatatttataatttgatttaaaaaaatgaaccccattctacacctttcaaattttagttaccaggaacaataattagtaatagaacaaagaactagaacttcatataagaaactgaggctcaagattaatattaggccacaaaatagagaaatttacaaggtggaccaagagttgacctcaattcttctaattctacaacccgtatcctactcatgcattaatctcatggaaatatttcctatgaataaacatatctgatttccagaaaggacttaaagggttacagaatatggggctactgagtcacttaatttttttttctttctcattttgtgggaggaggcattcaaaatctgttttctccgtaaaatctcttgcaattttgcaactgtcagcaaaggtagtcttgagttttcaaatttttatttaagaagcttttggatgataggaaaggcagttaaagagtgtgaaataactacagtctaaaaacatacatgaattcacagaaatttcagtgtatgagagagtacatgtaagcactttgatttttagagtaaaggattttctacttacctgattggtactgagctcaaaacacaggacagttgtgccaaaggtttgttgctgttttaacagtatggggttaatcagaatgtgaaagggcagtgaattcacatgtaataataaacaaatatacatttaaatataccagcctaattagagaagaagaaatgccattgatttctagataaaatggaggtgtgtgtgcttgaactttgcggataaggtccagttgtaatatttactgagcaacttggtaactttattcaatcaaaaagttggcatttaggccaggtgcagtggctcacgcctgtaatcccactactttgggaggctgaggcgggcggataaccaggtcaggagatcgagaccatcctgactaacatggtgaaaccccgtctctactaaaaatacaaaaaaaattagctgggcatggtggcgggtgcctgtagtcccagctactcaggaggctgaggcaggagaatggtgtgaacccgggaggcggagcttgcagtgagctgagatcgcgacactgcactccagcctggggacagagtgagaatccgtctcaaaaaaagaaaaaaaaagttggcatttataagtcggctggctgggaagcaaagttaatttgagttccactctaagttctgttacattttagcagaataataatgagtcatttatttatctttttaaaattctagttttcttactgatgagatgaggataataataccctgccttataggattgtggtgatgattttatgtatctaaatggtaatttaattgttatgattactgggtaaactttacaatgtaacagttgcagtgtttggtactagagataccaagataaaagttatggtcttctagaagaagagcaagaattaggtaatgtcggccagatgcagtggctcagtcctgtaatcccagcactttgggagatcaaggcaggcggatcacctgaggtcaggagttcaagaccagcctggccaacatggttaaactccatctctactaaaaatacaaaagatagctgggtgtggtggcatgcacctgtaatcctagctacttgggaggctgaggcaaaagaatcactggaacccaggaggtggaggttgcagtgagctgatattgcaccactgcactccagcctgggctacaggaatgagactctgtcaaaaataacaacaacaacaacaacaacaaaccagaagaattaggtactgtcaatgagtaataagtgctccaaaagcctaagcagcacggggtgcaataaaaccaaaaagaaggatatttaatcaagacaaagtggtgagggatggcttttagagtaagtgatattttacctgagtttttaagggtgtacaggaattaaatctgcaaaacggtgttgggaaatcaaattcttcacaatctgacgtatgcattgcatattcaataaatatttgactgataaatacataattgcatagatgtgtaaatatatgtttgaatgaattagttacctgttgataaaatttcttttgcctatgataatggttggaagaaattcatcatcaatttgtacactataaacaatcatatgattattgatccaaatattaacagaatatgatacataaattattgaaatgtttacagttccactgttattgtgaagtattttaacctataataaactaagaaaacaatttgcatctttaaaagatgttaaagtgtacatacatacaaacatgtaaattaaaacaaagcttagaaggtcaattatttttccagggaaaataatattatctttccaggtttttgaaaaattactctaaaaatacttatttaactttggatttcttataattacaattatgtagagttttctaaatgtatttgatatacatgaataaatgaatgctattatttactcttcagagatctctttgcccaatatgctttggtgaaaaagtacagaaatacacacagaaaaacttttcctacagcatttgatttgtatcactttcttaattacagcatgtctaatccacatgatgtaaaaaaaagatgtaaaaaatgatttatacacctgaagcttttttatttctagcttggaaggaatacaagggatcatacaatccaatatcattattttagatataagaaaactgaagtttggagagacaaaattttttttccaataaaacacatttagaaaactgattgagattaaagcactttcttctatattatcttttaaagagtgaatatataagaaacataacaaaaattgataactcaattgtttttagagatgtggcagactctgctattcacctacccaaggcaaatcccatctgttccctgataagtaaaaattgaatttattctcttggcaaaatatccagccttggagggtatagtaatcactgattctcaatgggtggcagtgctgctcccctccatgatgtatggagaatgatgtctttcatggtgattagccataggcatttaatgcctaggaattatgagacagtcctgcactatagaaatcggcatcatccaaaatgtcaatgctgctagttggaaacactggcttcactcatcatgccaatcgtgtccctcaccttgtcaggatttagtggagggatgggaatgttaaccagttcaggccaatgacacataaaatgaagtctgtgatagactccaatgattttttcttcctagtataaagaacaatcacttttgctcctaaacacttcatatggtttgttccctcttctcccagaataataatagcagatgctgagcagccaccatgagacaatgaggccactagcataataaggtaaccaaaaggatggcagagaagagggaaggattactgaatcaacttggggaatgtatgccttcttaattctcaattaataaacaacatatagccatatgggctaaacgctgtccatcagactatccgttatttgcttttcaagacatactaatggatgaaatagataccttgggtaaaattggttgttgaaaataagttatgtgaatattttcaggctattattaagtcattctaaagttaatgcttgttctaaagaggctgtatgctccattgatattagtccactgaatattatcattgctctgaaatattattagaaatttggtttaattatatatatatacttttttatatatatactttatatatatattttttaaatatttatatatttatatattttatacatatatttatatatatttatatatttatatatatttatatatgtgtataaaatatttatatattttatatatatatactttatatatatatatatatatgtacttttttttttttgagacagagtctctgtctgttgcagtggtaagatctcagctcactgcaacctccgcctctcgggttaaagcaattctcctgcctcagcctcctgagtaactgggattacaggatcacacaccaccatgcccagctaatagttttagtagagatggactctcaccatgttggccaggctagtcctgaactcctgacctcaggtgatccacccacctcagcctcccaaagtgctgggaatacaggtgtgagacaccacacccggcttaattatgtttttttgaggaatattacatgtaacttgtatcactatttaaataatatttcagaagtacatttatgagtcccctttctcacttttgttcatatcttcttgttaagaaactatatgtctaagagctttaggaaaaaaagcataaaaaaaatggtcttgaatgataagtagggacattacataatttagtaaagtaatgtaaggttaaaaagatggaacataataaatgactttaaggaagcaggcgatctagctaattcaggtaacaaaaatttgagatctcagatctaatcagtttcttttgcatatattagacaatgttactgaattttagagctggaagagatcatcctttgcattatacagaggttctggcttattttgaaagaatatttttattactataatattattcatggtttacttatcttaccatattagagcattcacagggaaaaaagactgtaatagctaaaccaatatacattcaggacatttttaaattatgcttttaaaaaagcacagaaaatggaaaatacactaagcgcctcagaactgtgtatcatccaacaagtaagagaaaaatgaggtgagttattaaagcttggattacacatttcaaagttgtattcaaggaaaactcctccagtaaaaatctgttctttgttatgcacattcaaccaatgtaagtttttgatgtgtggtactgagcttttgtattttaaaagtgcagtggccttttgaatttacaattcagtgcacagtagctataatactgtaataagtccttgattttctttcccttgaaatctataacacagctttaaagtgagtgtcttctcaatacaacttcatctatttttttgtgtgtgcttgttggcagtgatacattgtatggatgtaggatgggctaacatatgcctcagagtttcacaaaaataattcaattagtaccaggagttaacaatacatgctgcagaataataatatgtggaaatataaccataattttacattttctaagctggatatttttatttagtataatttcctttatcctgatcttatgtccacgatttaaatgtgcagtaaatatcaatgagttgtgtttttttctcttttactatagaattttttctccaggtaataactatcattcaacaacaatactttggattctgtaaaaaatctaaaagtaaaattaagaagtttaaacttttatgttcaactgacggacctcaaacctagatgcattagcctcatttggagcatattttaaaatattgatacccaggctccagttcaaaaattctaagttattgtgagtttatttattctggagtgaagcatgtctcttaatactttttaaaagcattccaggtgattctcattgcccaatgtgagaaccttaaaaaatatatatttgtttataataaatacatgcttagaatcaaggaatttttttgcacaaaggcgtggagattatcgagctctacacatcttaaaagattactatgctcacacatctctaggcaaaaagacactgctgcatttgacccgcagcaggaaattaatgctcttggcaattatctggatgcccatccatcatttggctacttataattataatggaaaattttattcatgtttcaagtatattttctaaacaaacaaaatgaaacaaaaacacaaaggtgggggagaaggagtgagataggatgcagaaaagcaggaagtggcaggtaagatatggggcagggagtgacaaagatacaatgccattatgtattttacttttatataattatcactttagagtaaataaaattagaagtaattgactattgactcattcatgaaaaaagcacatctgtagctattatggtagccataactgttataataaaaatactttcagacactgtatccaggggattttccaacaatatctttgcctacctattttgtatcatttctgctagtcttccttcttcttttttcttaatacaaatgttcctcagcttttctacagaagcttttttcaatctacgatttgaagatcacttgtacccaaactaccaaaacctacacatttcatgacctcattcagacacagtaaatatgaattctcaaagatggaggcctgcattttattattatattgattattatgcccattagtatttggaacatttgcctttatagcacttgccatattctattgaaaatattcacatttcagcaaaagaattttatggagagcagaaaatgagtttttttccttatattccaagcaaccctcatagtatttagtactttgtacatattaatatatatgtatgaagtaaaagaatggctcagccaagcaaacatcatcatgctcatttagacagataactcaatgccttcaaaacctcccaaaccctcttttgaatcaacttgatttttttgcctccaaaaccccgttttaaaccaacttgatctttactggtttctctaggtaggcttttgcctcatatccacacctttcttagatttttcttttttcctttgggtgttggattattgactaaaaccttaaaaagcagcctatgaatcaagtcaagcagatccctatatctagtgtagatatcttatgtttattcaccctacttctactttattagctgtttatccctgctttgtgtatattagctcctcattaaatatttttaaaataatataatttggtttttattagaattatataataatcaggccaggcattttggctcacacctgtaatcccagcactttgggagggcaaggtgggagaagtgcttgaggccaggtatttgagactagcctgggcaaaataagagaaagccatctccacaagaaaaatttaaaaattagctgggtatggtggagcgtgcccgtagtcccagctatctgggaggctgaagtgagaggatggcatgagcccaggagtttgaagctgcagtgagctatgatcacaccactgcactgcagcctgagtgacagagatgccatttcttaatttttttaattgtgtaataatttgtaagtttttagcatcagaatatttggaagtttgtattccgagaaacaattagcattatttagttgggaacaacaacaaacagtattcggtgtgtattagtttcctgatgccactataacaaatgactgtgaacttggtgtttaaaaccgtataaatttattttctgacagtgctggaagccagaactttaaagtcagtatcaccaagccagaatgaatgttttagcagaggctgtagggaagaatcaattccatgcttcttccagcttcctctggctgttgctattccttgatatgtagccacatcacttcaatctctgcctccatggtcacactgcatatagaaccgacctggataatccaagataatctgtccatctcaacatgcttaatttaatcacaaaagtctgttgcaatttaatctgcaaagactgttccttcatctaaggtaacatttacaaattacagagataagaacttgatcatatactatcatagtatattaacatacatgtatacatatatggtatacatgtataccatatatataaatatggtatatatattcttgtccatggttcctgactcataagtcccatagcccttttaatagtcttttgttatgatgatgtttgggtgctttaggtctcataagcaggcctcaggaaacagaatctctctctctgatcttctcctgcccgtcttttacttgctcctttttcttcctgaggcaggccttagaaactaaaaatatattctaatcttccaccacctttctgtcttggagttggacataaaaaaattatctcacctactttgtttgattgtaggtcagagacttccattttaggagtcctgccccataccagagggaaggaatgtctcacagggaggtcaagaagaatctgaacaggcaggtctgggatttccgctgtccaggccaggtattagatgacaggctttttgtccaattacatttgtttttatttatttatttattttttgagacggagtctcactctgttgccaggctgaagtgcagtggcgccatcctgactcactgcaacctccacttcccggattcaagcgattctcctgcctcagcctcccgagtagctgggactacaggcacccaccaccgtgcccggctaattttttgtatttttagtagagacagggtttcaccatgttggccaggatagtctcgatctcttgacctcgtggtctgcctgccttggcctcccaaagtgccgggattacaggcgcgagccactgagcccatcctttgtccaattacatatttcttttcttttttttgagacagtcttgctctatcacccaggctggagtgagtggcgcaatctcggctcacagcaacctccgcctcctgggttcatgccattctcctgcctcagcctcccgagtagctgggactacaggcgcccgccaccacacccggctaattttttgtatttttagtagaaacggggtttcaccgtgttagccaggatggtctccatctcctgacctcgtgatctgcctgcctcgacctcccaaagtgctgggattacaggtgtgagccaccgtgcccgggcctgtccagttacatttctacacggttgtccttgcttcaatcatgtctatccaatgaagtctccatgaaaggctcaagaggagaaagtaaggtgagcttctggacagctgaactactgggagcttacaggaaggtgaacaggaactcatccacatgcagggagagtgttgcaccccaactccacagcaacaaaagtttctacacactcagaactcttccagaccttgccctatatataacttcacctggctgattatttgtgtcctttaaaatatgctttataattaacaggtaaacgtaagtgtttctttgtgttctgtgtcccatactagcagattaatcaaacccaagaatagggttgtgggatccctgatttatagctggtaggtcaaaagcacaggtaaagcaatggggtttgtgattggcattggaagttcaggggagacagtgttgtgtgactgagtcctcaatctgtgggaactgaggctaactccaggtagatagtgtcagaatgaactggaggacacccagctggtatctgctgcagaattgactgcatgcttagtaggtgagggcgaaactccccaacccttttggtcacagaagtcttctatatttgtggttgtggtgtgagaacagaggggaaacaatttgtcttttttcctctgtgggtattattcacactattacaatgtggcatgaatagccttccagttgtccccaataattacttttctttttatttcttagtattaggatttttactaaataaagactgtattacccaacttcccttattcacaggtaaaaacataacaaagctttgactaattttgatgtaggtaacttttggaccattctctttaaagaaagaggtagacgattttcttctcctattcttcctgcttattggttggaatgcagattagatggtaagccattttagaccaagcaaatcacacaagcctccaggaatagaaaaggaaaaacagagaagcatttgttcctggtgccatctttgaactgagctttcatataaacttgaatgtaaacatgagaaagtaacatcatgtttaaattacacttttttgtgttttctgtatattctcattaatgaatatttcaattaatatgaagatgttttcagatgtcacagggaattttgtaaagttagtgatggagccttttatggtcagcaggctaatatagaggtagtcataatgacaaaaacagtcaaagtaggatttttcttaaactgcatactgctgcatgacttgtgagtaatttagcttttctaggattcaggtatttatctacatctaaagagtggttaagtgagtatctagcatatgtgtcttggagcctatgtagaatgatctcacagaaaattttagtgtttcccttttccttcttgaataaattagaaggagagactttactaaagaaaaattgaatacccctatttataaagaaatggctgtttttaaaaaataattttgaatttatctcagtattttaaattaatttggttaataatagtgtttacataggtaacttaaatatttttgaactcatggatttttttttatttttgggtgtaaaattcagttcatataaactttcaaaggtcccatatttatgagatttattccatactaaagttgtagataacatatatatatgtgtgtgtgtgtgtgtgtgtatgtgggtgtgtgtgtgtgtgtatatatatatatatttctattatggctgctcacaaatatttataaagcccctattaagttaatggcagagtaaaaagccatagaataacaacagtacatataattttaacaataacaacaacaaaaatcactggatttttcaatgttaccatgtcacatagcttgaaagaaagtcaggtaaggcaaatggcaataattcattttaaattttacttatctcttcaaaattttgtcaaattagacaaaaaagataatctattcctaaaaccagcttatgtttattcactttttttcctataagttctaagagaagttttcagtttttggttctgattgatgagacaaaagtagaaagaagtcttcacttcacgtcttgtgacatatttctagcttccagcacattataacattagcaacatctcccagagaaataaagtttttggaagataaaatattattgcacttagttttactagtttcaaatatttgcaactaaaaaaaccattttgttatttaagtacatgaaacatgaaaaatagttaacagtcaaaaataaggctaaaaatgaacctacacttggaaaagtgacatggaagagttctaagaaacaatttgataatttaagacttgtacaagcgcttacaaacatgtttatgattgctgacttcttgaaaatatcatttttgtaaaactgcatgtcctgtattgatagttaatgccatattctatattattattaacatattattatattattattgtggaaaaatctttgccctttaagggtatactttaatttggtgtcgtctatttaaaacacaatgcaagcagaataatactcttttcagttgaaaaaataggccgggcacagtggctcacgcttgtaattccagcactttgggaggccgaggcaggcggatcccttgaggtcaggagttcaagaccactccgtctctactaaaaatacaaaaactagcaaggcgtggtggcatgtgcctgtaatcccagctactcgggaggttgaggcaggataattacttgaacccaggaggtggaggttgcagtgagccaagatggtgccactgcactccatccagcctgggcaaaagagcgagactccatttcaaaaaaaataataataataaaaataagaggttggggacaaattgttcctcctccatattctcaaacacactatttatatttgtagtagaaaaattatggggtttcattgtatacaatttggtattcttggaagatagataggtagataatagataaatagatatcagtagacagagatattctttttctttgttcttcttgacaataaacaatatctgttatttaccatgattttttctatatttccaatacttttcaacttatcctagactctaacatatagtaggcactggatttatatactgactttaaaaattaattttatctggttataaagacaaatctaaaagactatttcctcaagtattttgagaaattgcagcattactgatggaatttctttcttttaatgtgattttaaattgcaaactttactgaagtaagaaaaagtggaattattatttattgagcattttctcccagctgactctgaactaggaactacacatataatcttattttatagtctcacactaaacttctgggtttaggtaatattaactaacatgttttatgacaaagctgaagctctgacatgttaaataacttgtcttactttatattggccatgactatcaaatttgaattcaacatttcttgattcaatgcccattttatttctgctatatcactactgttatggcatctttatttaaaacagcaatatgttttactgagttatcagtagcactttcttacataaatggtaaagcttaccttccaccattgacattgattattattatttcccataacctgccctagggaaagttttcttacagggaatgatgctttaatatatttagacaatggtctgtaaccatgtaacgctgatggaagtctctggaaccattcctgtaacacattgtactaaggaaaaatatatgcaaataccctgttagcagcttctgtttccttatagaaagcaaataatctaatagaatttttgctagggcagaagtggtgtactcactaggattacagaaatgtcaaccacaaagaagacataattccatatgacagaacatctcattcattttagaaagtaagggtcccatctgatgttttttttctgaatttttacatttaaattatatgcctctattagaaattaggatcattttaagtttttgaaattttcgctcttttaagaagagaagtaatagcaacacatgtaatatgtatgcattttttaggtatagattttggaaggaagcagaggaagactaaaatctctcaagccatattttgccactgttttcctgaaatactttttattgtcctggaagaatgaagatagtttgactcccaatggggacacttttatgattggttgatctgaaagcatgcatatggcaaggacagaatcttaaataaaatgtattaaaaacattaagttaggcaggatagtttttgataataaaatactgaagcaatgaaattctgtaaaattgtatatactggaagaacttggattgtgtatatgtgatattgagataatcaaatattaccggaaataataatgaagactgtacattaaaacctttcactggtcatggtggtgttcaccagtagtcatagctactcgagaggctgacacaggaggattgcttgagcccagaagtttgagattgcggtgagctttgattgcaccactgcactccagcctgggcaacagagtgagatcctgtctcaaaaaaaattcataatcatatttaacggacttggtgcaagagcatttaatattatgtcaaaatgacaataaaaattacaagacactaaattaataaaggcaagtttgcagtatcaggctgaacagtgacttccaagtatatcatatcctagtcgtagacctggtacatgttacttgtatatgtcttataaggaaaaagggtctttgcatatgtgactaaggatcttgagatggggagattatcctggattatacaagaaaattctaaagatgattattttaagagccctaagtatattcttataagagggagggagagggagacttcacacacagaaaaagagtaagcaatgtgaccatggaggcagaaattagaatttcaaaggcataagagctctttataacctagtggtactaattttaaacttctgacctccagtactgtgatagaaggaatttatattgtttcacacactgaattggtggtaatttataacagcagacacagaaaacgaatacacccacattttaataaaaagaaaagaaaagtctgatgtaaaaaacaattattgttaggaagattacctaatgaatataaaagatgattgatcatctatgaaagacttatggactgcctttgaaagtaaaaatagatactttctcttagtatcatatgggaacatcaaatttaattcagttacaaatataatgtgtaactaaatgagataggaaagtaataatttattttatgtgatttgacttccttggatcttcctagtagaaagacagtaggtttaattttcctttaaaactagatattccatctctcaatctttaaaggggtgaaattacataaaagaaacaagaaaaaaagttttcagaaactatgaaagattccccagaatgctttttatcaataaaattgaagtattttaaatgttaatagtaacatttggactcctattccaaatggtgatggacgttcttgccagtacaataaggcaagaaattaagggagaaataaaactgttcctacttgaagatggcatgtttatctacgtaaaataatcccaaggaatctaaaaaatgttcctagaactaataagtgagtacagaacagtcaataaacagcagaagtcaattatatttttatatgccagcaatgaactagtggacaccaaaactaaaaataaaataccacttagaaacagtcataaaaaatacttaggagtacgtataagaaggcttgcaccagacttgtatgctgaaaactacacaatactgataaaagaaataactgaagatctaaaaaatgaaggagcacattgggtttatggatcaattgactaaacgtagtaaagatttcaactctctcaacttgaaatacagttgtaaagcaattcttatcacaatttctgaattgttttttatataaaattcatacagtgagacaaataaccaaatgagctaaaacaatcttgaaaaagaataaacaaataggtagaatcagtctaactgatttacagatataatatatagctgcagtaatcaaagtgtgtgttattgctgtagggatagaaaatagtttgatggaccagaatagagaccccagaaattaatttacacagatatatccagttgatttttaatagagttgcaaagcaattcagtgagggaaagactgcccttcaacaaatggtgctgaaacaactggacatacataggtaatatgtatgtatttatattatacatacatttataaatacatgtatgtatttatattatacatatatatatatatacacaaaaaatatatattatatataaatatatacaaatacatattatatacaattatatataattattatatatatacagtaatttttatatatatataaaactttgacttaagtttcacctagtaaacaaaaattaaccctaaatggatcatagaattaaatgtaaaatataaagcataagtaaaaatatttagcatctagagctagtcaaaaagtgcttagatgacaacaaaagtatgatacaaataaaaaattgataaaatggacttctgccaaattaaaaccttttgtcctgtgaatttccttattaagagggtgaaaagacaactttcaaagtggagaaaaatacttgtaaactgtatatgtaataaaaagctaatatctaaaatatatgaagaattctcaaaactcaacaaaggaagacaatctgataaaacacagctaaagataggaagagacatttcaccaaagattatatgcaaatcgcaagtaagcacatgaaaagttgttcaacatcattagcaatttggaaaatgcaaattaaatcactacatatctatatgtattttgttttttagccatttagtggaatggctaaaagaaacaaacaaaaaaacagtgacaatagcaaaagttggtgagaattcagaaaaacttgtccattcgtacattgttgctggtaatgtaaaatggtacaaccactctggaaatcagtttggcagtttctttaaaaaaaaaaactaaatgtgcaaatgctatataactcagcaactatactctgtaaaggatgagataaacttttttatctcttcacacactcaacacgcatacttctgtgaccaaatgtgtgaggatattttacacgtcaagtaattctccagcagaccccaactgggtatcttccagttcaattcaattctaatgctatctacctggagatatgtcagatccataggttgtgggctcagtcccatacgattgtcctcattttagatgccagttgcaagtagtaggttgtcacctatacttctgactgagtgattacaaactgggcttcccatgatttcccctatggattgaattaatttgccatgaagtctcgcagaactcagggacacatttattggcatgatataaaagattttataaagaatacagatgaacagccaggtgaaaaagtacatagggtgagatctgcaagggtccaaaatgcagaagtttttgtacccatggttaatatttatcatttttcaacattgtgctttaaaatatgtagtagaattgagtatccttatcaacactgttttcacagaatatataatcaagcatctttgctcagtattataatttctgacattatatattaaattataatggagaatgcaatagaagattatacacgttgttaacctgtaactgaagggtgtagtgagaaaatgattatattatatttaatcattcttattctaaaaacaatgttatgagaatattaggtatgcagacctcactatttatggggaaaaaaagaaagtttgggtgaagttcttatttgcttagaaatgcatactctattgtggttcagtgggattaatgtcattttgaagtggaggttactggagtagaatattacttttttttaagtttaatcagtttgctgtgtgattcaacaatcccctcaggtgcaatttgattcagtttcataaaactgtttattctgtatgaatttgtgaataaatcatactcctcgctactctgtaaggttcatttagtacatactcggtagaaagacaacgttttttcaagaagatgaagacatattgtagccttatgtcagccataaggtttaaactcaacacaggaatttatagctgctttttctttttagaagcacagtctagtcaagcattaaatgtatagttaacagatatccaatagtcacaagaaagttgacaacttaaattacttagttataatgaagataaatagcaatctaaacatgggtatatattgcaccctgcaatgcaattgactctaatgttgttgccaggcaacttccttggatagattaaacattcttcctgtaattgatggtatcaagacacacacacacacatacacgcacacacacacaactgcagaaatgaccaaatctcttgtgttttaaaaaatagtgtcttcataaaatgtgtttgaatgcacacatgggtgacatcgaaataaaattctattttgtagtatgcttcattttgtaagtctttaataaaaatatgacccatcatagattttcaatcactcacagtacatttaaggattgaaatcagctattttctgagatgaattgagtgttcttaagagatttatatatgtgtttgaggagattttgtgaagcaaaaattaattagaatgacgtaaaataaatttcttatcatttatataactggaataaattgttattacatagtaaactctctctctctctctctctctctctctctctatatatatatatatatatatatatatatatatattcttgcatattgggtactttttaacttttctaattttattttatattttttaaattttattttttgcttccccaactggtttcccatacctagagtctctgtctctgaaattcacatacacaaatactattgaaagatttataataatttttggtaggaagggacatatttaaaaattatgtaacatttgtgactcagaaaaacaagcttgctaacctatttatttttctctttgaatagattgatctcattatttaattgttatcaaaaaggagagatagaacttctgtctccatttttccagaatagtatgtccagctattcccttgttcatttttaatgtcttctaaatagtatataacctattatttaagttttagaaatggttcaagtctgtctacgttcagtcactcaatgactttttgtgaagatcagaaaaattttctagacattttctttctgatttattttcttatgatgcccccagagtgtgtgttggttgggctggggtagcgtagtaaggaaactaaatatctaaggcagcaagaaatttcgagaaagaaaattaatctactttattacacttctctgtgaagaactctaaattcaacagtactcattctatttagctactttatatctagaaattagttaatgaaaatactaatacaaagtaactacaggtttattcattgggccaaccaaattttatcaaataaatgatatgttttaggaatggtaataggtgctgaaaatagtaataataagaagaataatagtattccacaattaaagcactgaaagaattcaatgccaagagcgtaatgataatgcattggcatttatagaagctgtgaaagttttcagattcaaaatgtagtcactaatattaaaaacaaacaatcaaaaacctgtggcaattggagacacagaaggccatgaagtgtgcattttcatctttgtatgcttgttaacaaaaactattacaaaggactgcaaaaaaaaagtttgcacaaaagacatcacaaccttacagaaaaattacttctacaaggacttcagcccagcaactacctgttcaatgtcaaaatggaattaccctgattattgatctttgtagccaaggataattatttctggtatggtttagaattgtgcccccacccaaatctcatgtctgaattgtaatccccagtgttggaggaggggcctggtgacaggtgattggatcatggaggtggacttctcctttgctattctcatgatattgagttatcacacagcctggttatcaggagaaccagcccccaatttttcaatgtaggtatttcgattttccctaagtgttggccgatctgagaaataaagagaaagaatacaaagagaggaattttacagctgggcctccaggggtgacatctcatatcagtaggtctgtgatgtctgcctgagccgcaaaaccagcaggtttttattaaggactttaaaggcggagggggtgtacgaacagggagtaggtcacaaagatcacatgctttaaagggcaataaagatcacaaggcaaagggcaaagcaaagatcacaaggcaaagggcaaaattagaattactgatgagggactatgttcggctgtgcacgtattgtcttgataaacatcttaaacaactgaaaacagggtttgagagcagagaactggtctgaattcacatttaccagggcaggatcttttccctaccctaataagcctgagggtactgcaggagaccagggcataattcagttcttatctcaaccgcataagacagacactcccagagcggccatttatagaccaccccctaggaatgcattccttccgcagggtattaattattaatattccttgctgggaaaagaattaagcgatatctctcctaattgcacatccatttatagcctctctgcaataagaaaaaatatggctctattctgcccgaccacacaggcggtcagacctttggttgtcttcccttgttccctaaaatcgctgttattctgttcgttttcaaggtgcactgatttcatattgttcaaacacacatgttttacaatcaatttgtaaaatagtggtcctgaggtgacgtacattctcagcttacgaagataacaggactaagagattaaagtaaagacaggcataagaaattatgagagtattaattttgggaactgataaatgtccaggaaatcttcacaatttatgttcagacattgcagtaaagacaggcgtaagaaattataaaagtattaattttggaaactgataaatgtccatgaaatattcacaatttatgttcctctgctgtggctccagttggtccctccattcggggtccctgacttcccacaacacctggttgtttaaaagtgtgtagcacctcccactttgctctcctcctctgctctggccatgtaagatgtgtcagcatccactttaccttctgccataattgtaagtttcctgaggcttccccagccatgcttctgtgtagcctgtggaactgttagctaattaaacttcttttatttataaattacctagtatcaagtagttccttatattatgttggtgtaaaaatagcaatgtgagaatggactaatacaaaaaaaggtagtgggagtgaagttttgttataaagataccttaaaacgtgtaagcaactttggtactgggtaatggacagaggttggaacagtttggaggactaagaagaagacaagaaaatgagggaaagtttggaaattcctagatacttattaaataatcgtgaccaaaatgctgatagtgatatggatagtgaagcattctgaggtggtctcagttgaaaatgagaaacttattgaaaactggagtaaagacaactcttactacgattttgcaaagagcttggcagcattgtgcctctgaactaggggtttgtggaactttgaaatttagagagatgatttaggttatctggtgtaagaaatttctaagcaacaaaacattcaagatatatcctggctacttgtagtagcctatgcttatattttttagcaaagaaatgaattggacctagaaattatatttaaaagggaagcagactataaaagtgtggaaaaattgcagcctggccatgtagtagaaaagaaaaccccattttctggagaggaattaaaattggctgcagaaatctatataagtaaagaggagctaaatgttagtagccaaggcaatgggtaaagggcctcagaggtcttcacaccagaccctcccatcataggcccggaggactaggattgaagaatggtttttcaggccagactcagggcctcactactctgtacaaccttgggacaccgctccctgcatctcagctgctccaactctagccatggctaacaggggccccaaaatttctcaggccactgctccaaagagtgccagtcctaaggcctggtggcttccacatggtgttaagcctgcaggtgcacagaggacgagagttaaggcttaggagcctccacctagatgtcagaagatgtatctatgtatggaaacacctggatgtctagtcagaagcttgtagcagggttgtagccctcatggagaacctctaccagggcagtgcagagggaaaacgtggggttggaggccccccacagattccccactggggcacttcctaggggagctgtgagaagagggccacaatccttcagacaccagaatggtatttccaccagcagcttgcaccatgcacctggaaaagctgcaggcactcaatgttagcccttgagagcagccataggggctgagccatgtagaaccaaagagacagagatgcccaaagttttgggagcccaactcttggttcagtgtggcctggatgttagacatggagtcaaaggagattattttggagctttgagatttaataattgccctattgagttttggatttgcacagggcctgtagcccctttgttttggctgatttttcttttttggaatgggagtatttaaccaatgcctgtacccacattgtatcttggaagtaactaaattattttgattttacaagatcataggtggaagggacttgccttgtctcaggtacaactttggattgcagacttctgagttaatgctgaaagaaattaagactttaggggactgtttagaagggacaattgtattttgcaatttgagaagaacatgagatttgagagggaccatggaccaaattatacagtttgtatttgtgtccctacccaaatctcatgtatgaattttaatcctcagtgttagagaaggggcctggtggaaggtgattggatcatcagggtggacttcctccttgaggttctcacgatagtgagtgagttatcacaagttataagagtgagttatctggttgattaaaagtttgtagtacctcccccttcactctcttcctcctgctctggccatgtaaggctgtattttttaatatatattccaaggtatttgggttttgtgattgcaagtaaaccgtgatttttaacctcttttttccaattaaacaaaattttatgttaaattgtgtgtctgataaataaaaataaaattgacttttgtatactgaaaaacagtacttagaataagaatggagggaaaatggaccagctgtagacatttcacagatagaagaaaaattaatgtgggaagtactatcgagaaagagaagagggatagatgacttcgctcttctgggtttcagctaaaaatctaagtgaatagctaataggaggcaaagaagcttgttcagaggaaaatgaatgaaacaagatgttgagccttaaggtaagatgcctaataaactgaatatgggactttgaaactcaggagagtatacagagctagaatcataagtttgccaatgacaaattgatactcatgttactaaattaggtgagaagggacaagatctgttgctcaagatatatgaatggtagattggacctgtgtggaagttttcttctgagagattttgttgctgaaatagaaaaggaagaggcagctgagaatctgaagacatgggaagtgttggaaatttgcgcagagcagagatgttacaaagtcaaagatttgttagagtaatttttcggggggaataaagtagaatggtagtgttacactagggggtctgcctaaattattgcttatgagctgaacttaaaactggtcagcaagtgtgtgcggttttattttgccatctttagcttcccaagtattggcatacttaaaaccagggctggatttaaccgtgggagtttggacatgttagtgtaatgataaggggttggagggagagcagaagtagggatagggaaagagaagcaggaagagaagagagaattgttttgttcagtaactattttttaagtaaccagaattgtcagcacataacatatagttaaaaccaagttttgactgcctagaacaagaagcatttcaaggaagaaattgctccagaaaaatgcttacagcaagttttttttttctgcaagtacatgaaaagcaacttgaataaagagttgagaagaaagatataaaaaggtaaaattaaaattcatttgatagtttttattcatctaaattcatattaaggataaaaatcttgaactaaattgactattgtgggaaattaaacctgaagaaaaaaatacagaaacataaagattctaagaatggattttaattaatgttaaacaagttctcaaaccagaaagtcatcggcattagtcaatacagtgtaaagaaaaatacatttttgttttttaattattctcctcacggaaatagtgtttacaatattatgtgtgatcagcaaaatgtagcaagttaatcctattctcataagaacaatttcaagtccaagagcctcctttataaaatgcagggcacatattggttactttttattgatttagacaatatatgagttgtcagaaaaatcccatttttaaaatctacaacatgatttcctacctgtaggtgttttaaaacaatcgttagttacttttttagagccaaaataaattcacttcatgttgaagatctataatcttaatcattgtgtcttttcttgtttttctaactagtgtaccttaatggctgactgctcaaaaggagattagatattttgctacaagtgtacttgttacagggctgtttcattttgaaccgaatgggaagaactgcttattaattcaagccactttttttgaactgacatttccctaatttcatcagtagaagtagcagctattttatgctgctgcattccatgttattaatgatagttcattttatagaccaatgtcctttctccctgcaaaacaagtttaactcaatgtgtgactgagcactatttgtactacagcaataagcatctataacaatgatctatggaaagatgcatcttgagtttcaactggtgatactagacaaacctctcctttttaaactttccacccctattctagcagcagcagataatctatgggaaaattataggggtagaaaggaatgaatgagaggcaaggtgacaccgggacctcaagtctctcctggacttgtttattctgattgtctatcaaaagagaattacctctgtacatcagcaaacctgaattacagagaagagttaagtcaattacaggtgttctaattgtagcaaaattgcaataaggcctggaatgacatggatataagactttatttcctcaactctcatgcattctacatttattaataataatggtatgctagaccctatgttaataactaacatacaaagataattacaacatggtacctgtaagaggaggggataataattgagagaagagatagtcagtgggcatatgaatacacaggagtatcatggatatatgaaaaagtgatggaacaagagtttagtgtagtagatgcagtctgtattgttaggactttgaagtcaatctaagtttgaggatttattttttcctatgcacaatggattcatcataaataattaaatatttttaaagccagagaatgatatcccagtatttgaattttagaaagatcatcctggcatgattgtggagaggatcaatgaagatacaaaaccttgaaatagggaatctatcaaggagaattcagagaggacttcataggactctaagaaagaacatttggaaaggttaaaagaaaactaacaatatgtcagaataatgggtatgtccatacaacaaatacaaaacctattttaatttgtgttcaactgtagcaaatgttgatcattagcaatctttgacatggcaatttcaatggattactggaggaaaaactctaattacacaaaaaagatttcaggaaatataaccaggtgaggatgactctaaaaagaatggttagcctagaaagagaatgtcatgaaatgctatttagaggggaaaataggcttatataaaatacatttcgaacatttgtgtatagagggatatatgtacacatttgtatataatagaccaaaaatctaatagagacagagattgaaaatggatcaaaagaagaaatattagttaactaagtcaagatagctaagaaagagtagacaatatgccaaacctgttggaagtattttttattcaagtgaaggatcatgtcttctggctgagatggaaaaaatgtgataagcttttcaggataaattaactgtgggatggaaaaatttacattctgagataaaaatttttctttataaatcagtatttgatttaattatgaatcaggcttatattaaattggtaaaggacttttagagagaatgctggagatttttaaatgactgtcatacaaaacagaagactgaatagctgtgacattaagaaatattgaccagaggcactggttacccagttgaggattgacactacacctggatattggcagcaatcttattagtttcaaaaatgtttctagactaaatgctcacatttggccaggttaaggtgcaagagagtaactagattagaccctgcagaataacaggaacaaagaagtaggagtatcatgtaaatggcacttgatatagatctcatgggttttggatgagcacataaggaagtgtagccaggaagaagttgtgaaaaattaggaaaaggactaaacaagatacaacatgctcaatattatgagttgaatcatgtcactcagaagatatgttgacatcttaacctttggtatctacagctgtaacttcatttggcattagggtcttcattgcagatataatcaagttaagatgatatcattggactgggccttaaattaatatgaatccagaagtcagaaaaagcaaggaaagattatttcctacaggtttcaaaagaaacatggcccgccaccactttgatttcagactttttttgcctccagaaccatgagacaatacatttctatttttttaagccatctaatttatggtatgttgttacaacagcactaggaaactaatacatccaataaaaattatcaccaacagtctgcatcggtcaactggttgttagaatgcagagacaactaaatagttgaatatttttttttcaaaattggttggtttatgagatatatgataagaatatagataagtggattgaacaattgtttgcacattcctatcttaaaatattttaatgttttatattaaataacatgaccacaatgaccaatagaatgaccacagtgttcttcagtgttgaaagagcttaaattttcaataatctttaaggctaaagtataccttgttaaaataaagtaaaaacgtaagtaatcatgttatctgcttaaatgttgaaaaatctattgatggaagtttatttgcattttctaccccaaacaaagcatatacaactaataatcctatttatctgctttagtattagtaatttaattaaattagaatttatgtaaattgaacaaaatatattagaattaaacattcaccctgactgtgaatgtgggtacctgtatatatttttgacttataaatgcttgacataaatggttggcttaatatttaaatttttgcatgtttacattctttgaatgagatatatttataggcagtatttgcaatatgaaattttatttccaccatgcattatgtatatttcatggatgaaggagagatactttcttttaataagaatattaatggtgataatgatgataataataagacctaggatttaattagtgcttattttatcacatactttacatagactatctaatttaattatcaaaagccaaaaaacaagcaaaactacaaagtagctgtaattattatgctcatttgcaaatgaaaaaactgttgcttataaactgagtttcttgcccaacattatacaactaagaaatggtggagacaagactagagtcctatcacattccaaaacctttatggttaataagtatattatttgaataaattttgtaaatacgtattcaaagaatgtacattctttgcacaaactttttttagctattgaaaaataaaagccatttagaagggctattgataaaatattctacaatcttaattttctcatttcaaatgctgctcatgactaactgtaggtagattgaatgatcagagcatatgatttgtgaatcattcatataaacataagtctgggttatgctagagtggttgatggatggcctgagtttttaacacataagaggtaataggggctgggcacagtggctcatgcctataatcccaacactttgggaggccgagatgtgcaaatcccttgaggtcaggagtttgagaccagcctggctaacatggtgaaactccatctctaccaaaaatacaggcatggtggagcatgcctgtaatctcagctactcaggaggctggcgcaggagaatctcttcaaccgggaggcggagtttgcagtgagccaagatcgtgccactgcactctagcctgggcaacagagcaagactccatctcaataaataaataaataaataaataaataaataaataaatgtaatgaataagtattcatttttgttgaaaaagtgaataagtgaaagtataaatgcatatttagagaatattgcaaagaactgagctcatcagcaactgattacaaggagtaccaataaggagaaacaaagtttaaaaagagtaaagcatcatgtgtgtagaaggaagaaagagtattaaagaaattgcaaatataactagctagggaaggaaagaaaattgaaaaaagttgattggactctgccaagaaatcacttaggtcactgtaaaaataacagtagaaagttgaggtcaaatattctgctgaaattatttcctagaaaaaatgctcatatttttgtttcactcacaactttcagacctttctctaggttaaagagttattatggttattgcaaaagacgttacagaacagcaaaacaaaaccttttccaaaatttcatctatatagtgtgtttcaatcaaatgcattcatgagggaaaaaatataacattatttctccctccaacttttaaaatttcatgatctgttataaaattattactgaaatatgaggttattaatgtagaatttaataaaattttaggatttcttatacctaaattaagataatttcttcaatcttacagatctgttaaaaatttctgctcaaagtcctttatccaaaaccctaattccaaggacttgaaccagtcatattaaaaatgaacaaagaaactgagttttatttcagcctctttgagatatacatacatatatatgtacatatatccatacatacataaattttaaattatatataaatatatatcacatagataatttaaatttgaaaattatacaaattaacattaccagttttgcaactcagtgagttttccagcttcctagatcaaggaataaattaagaggcctattctgaattctgaaaggggaccagaagaataaaagcatgacactttagtcttacacaaatcttctgaagggagtaaaaaagaagtaaaaatagagcaatggatagtaatattttggtactcaagtggagatgaatggacaaggccatttcacttcatgaagttttcttgtagtggatggtaatgaaagaaaaatgagacctaaacactcaaggactcaatgtgtttgtgataatgtgaagggtgtgtttcatggtactggagaaggaaggctaatattgaccctatgtattaagagagttgtatcagggcatagaaaaaagcatgggtagaaattactttgtatgttatgtgttaagtgcagcagcaaaggtgaggaaaacagagataggaaaaaacactacttaaacttagcttaaatatgactgtctttcccatagtttaggaattgcaataaagaccataattttttttttaaaagttaaccattttaagtaggattctgaaactctgagttattcatgtagacttggaaaaaaatgcattttacaggcctggtgtggtggcttatactcataatcccagcactttgggagggtggggtgggggaattgcttgaccccaggagtttgagaccacccttggcaacatggtgaaaacttttgtctctaagaacgatttttaaaaattagcggagcatggtggcatgtgcccgcagtcccagttactctcgaggcgggagtgggaggatcacttgagcccagaggttaaaacctgcagtgaactatgattgtgccactacactgcagtctggactacaaagcaagatcctgtctcaaaaagaaaattaaaaaaaaattaaaactgcattttacaagtgtttactgtttaagctaatgcataggtagcaagactattcattggttctctaaattcgcaatatttacagtaccataaaataggctgggccacctcttagcagctcataatatgaagtcattgctgagatgaattgcaaatactaccagttcatctccataagaaataaaccgtagaaaaattcataatactttaagaaccacattttgctttgagatgtataacaacttgcattccaagattcctaatattatagtttgaaacaattttaatttagaaatatatccagttccatatagcctgctacttgaacagtttggccataaaaaatcaagaataaatatttacctgacatatatatatatatatatacacacacacatatatatgtgtgtgtgtgtatgtatacatacacacatatgtatatacatatatatgtgtatatatatacatacatgtatatgtgtatatatacatacgtgtatatgtgtatatatacatacatatacatgtgtatatatatactttttctggtaaaatctgaatcatagaagttatgctgcacatcctttcaaattggttcacatttcaaaactccttttatagtaataaaatatagtgagacattgtgaaccaaacaaaatttaatgtcagtaggaatttgagtatcttctctggaaagtagaatatacacctttaaacttgggtcttctttgtcctgacttttgctgacttttgaatgtctctacatggcagaagtaaaattgagcatttctatgtaacagcattaatgatcagataatcaattacacaaaaaaagtgtttaggctatacctatggttcggataattgttctaccccttgctggtaaagtgacatttagatttccagaagttaggcccatggtacattcatcaaattcattattctttacatattgattgattgaactgaagctcatacctttggttgtcaaaaatctctttttccagaaatatattttttcccaaataaccctatttaatgatttgccaagcagcctatgcttgttaaaagaccttggattggcctggcgccatggctcacgcctgtagtcccagcactttgggaggccgaggcagggggatcaattgaggtcagcagttcaagactagccttgccaactagcctagagaaaccccgtctctactaaaaatacaaaagtttgccaggcatggtggcaggcgcttattatccaagtcactcagggaggctgaggcaggagaatcgcttaaacccaggaggcggaaattgcagtgagccgagattgcgccactgcactccagcctgggcgacaagagagagactccatctcaaacaaacaaaaccttggattaaaaaccaaatgtaaaatataaagagaaaaatataagtcccacatatcatgcgtatgttatatctggtatatgatcaaggaaataaaaaagtacataaatttgaagtataagcagaaattgtaagtcttaatttgtaagtcattctgaagagttattctcaattacttaaatgtatgacaaaaccagtttaggcagagaaactaggttacttactagtggtttgttacaaaatatgttttccttgaattgaggcttagaaatggagttttatccaaagataagacagaatgatacagattgacagaatgatgaaaatcaagggggacccacaactctaaaaaaatggagatagcattaatatgaaatattcaaccatcccaaaacctttttactcaaatctgcccttcaaccattcctatccttctttactccttctctcaccctagcttaaacacaagattaactgaagtacaaaattctgtcagcagatatatagccgctgttcaaaaccttggaactataagaagtcctggattgttgccttaattattaaaaatataacttatgagaaaccaatttattttcaaaatttactcacagatcagttaaaagaacatcagtatcactgaaacagtcatgcatttggaaaaatatcatttttcaacccttgacatcttaaagcttgctacagcttataaaaacacaagcaaaccaaaatctctggttgtaagaatgtgctgtagactaaatcttatggccaacatgcaacttctgtgtcaaataaatgacattttaaaatcaattttcatgcctatgctaactctcaatttaaaaagaatcataaaatttctatttcctttttataacataacatgggtcaatattctggctaatgtgacacaattcaataaagatattgtggaataatttaaaattcaattgtactggcaattagtttccatttcaatatactcttctgaaattgttgtattttattttggaaaaaaaacatagagtatctgggttactgtgacaaacaagtttttttctgcactgcatccctccagcaagggcttaatatatctgatatgtcatagtcaacattcctgctaatctttcccaccagtgtcaagtgctgagagccatcacctattcattttgttgtatagtggaggaagaaagatgtagaatgggcagaaagtaatctgcacgaacatcagaataatatgggctttttgagcacagacacaaaagagatgcaagtagaattagaaaatcagctgttttctgagatttgttttgcaactctttctttgcctgtactgtttgcttgaatgtaaattattcttaattttattatattacttagttaatgaatgttttaagactaaaaaaagtttctatttgtatcaaaactttatggatttcacatatttcacatcatacagacagggtgcattaaataaaacactattaaatattaaatattttgacatctatgaagcaatattattattattgtcatttaacataaaattatggaagttggagttttaatattatgttagcatgtaagtgctccatttaaataaaaaaaattaacaagtctcagaaaacataaggtaatgatagtgttttcaattttaccaacagcaatggaattttctatgatagaacaactaaaaatttgactatccactatataatttcttctattgagtgtttgtgtgcaaatgtatgcatgtatagcacatgtacatgtataaatgtatgtgtgtgtatagggaatatagtgtaataattgaattatattttaatataattttaagtttaatgatactggaaatgactcatggtagaaagaattgaaaatgaaaaccagaaaagtccaaaacttgatgtgtaaaatatccattcataatgtattgaacattacattacattattatccattcataatgtcttgcctgtaatgaactattagcgtgattcctcacattagaattggcactgtcttgcctaataatgagaaagtaaaaatgaagttcttgttttaaaaatgtatctatttagagccatacccatacaagctaaatatttcaaaaaggagcctcaaaggggtaggacatagggaaaataagtgtgactatgctttcgagagatacaatcttccacttagaaatatctgcaaaactaagttgttagtataggttagcaaatcacacacaagaaaggcctggttatttgtgtaaggatgaaagaatgcaaattaaagagagatctctcttcatagcttaaacttcattaaccaacatatataataaaaactttgatagaaggaaataaaaattagaagcattgtgtttaaaattagaagaacctaggttccagaatcattgcagccacctattaacatctttaaacctccatttcatcacctgtaaaagaagaatcttaatagtgctgattgtagctgttaaaaggtttagcctttctctttagatttttgtccccactcttccaatcatcacaggaagtgcactatgcatcctccatttggtgagaacctctcttatgttttattcagtgttctttttttagcctgaaataaaatttcttacctttcttttgatgtgaaaaaatgttggctatatacttcttaaaaattatatttaactgttaggattcaagggtaccattccaccaattcactcaccaaactaatttcagagtcagatctgagcaacggctgactgttctaaataatacctccccagcttctgaagcaatgaaatccattgattcccaagtggggatggctgggcagcatgaatagcatctgcattataaatacttatatagagcttaatctcatatgccaagcactattctaagaacaaattgattaaatcaattaattcttataacaatctaataaaggaggtactactaaaaatatatatacatacatatttagacagaatctcactctgacgcacaggctggagtgcagtggtaggaccccggctcactgcaacctctgcctccagggttcaagcaattcttctgcctcagcctcccgagtagctgggactacaggtgcgtgctccaatgcctggctaattttttgtatttttagtagagacggggtttcaccgtgttagccaggatggtcttgatcttctgacctcatgatccacctgcctcagcctcccgaactgctgtgataacagccgtgagtcactgtgcccggccctacattttaaagctaagtctagacagtgagataaagtaccttattcaaattcccatactcattaagtgatagaatctgagttcaagcctaggcagcaatgtggtggctccagatttcttgctctgaacattatactatgcagtctttcatcataatttaagaagaatgagaaatacactgacaatattttcaaaactgtttagtaggtaatctccacgagttgagggagggacctggtgggaagtgattggatcatggggggtgtttacctcatgatgttctcatgatagtgagtgagttctcacgagatctgatggtttaaaagtgtagcacttcctcgctcttgctctcttgctctgtctctcctgccaacatgtaagatgcaccttgctactccttcactttctgccataattgtaagtttcctgaggcctctgcagccatgcagaactgtgagtcaattaaacttgttttattaataaattacgcagtctccagtagtatctttatagcaatgaaaaaacaaattactatactgttatacatattatacctgtatttgaccacttgcatcctagcactgttaagttgcagatggtattgaggacattctctaatgcctttgactccaaaatcttgcaccagccaaaatcttgcaccagccagcaaaggaaattacatgatgatcccttttcaatgagaagactgaagtattgcatgcatataactttatcaatatcttgggtatttccaagatgaatgaatgggtattaatttacatttgtataactaaagactcattctgattatttcttctaatttgcaaatgacttattttcttttaatatttaaactgttttaataaaattaatatgccaatattaataatcatatactccagtccagattatactcatgatatattttatctcaataaaataaaaattaaaaagttttcctctttttataatagaagcaaactatgttaatgcaataaacatatttaaatatctgagtgtatttcacttaataactgtattagaagtatacaacttattttgcagtcattcaaataggcagtatattatggcatctgccccttaacaagtctcctctgaatgtgtggtccatcagtcattgactcttcgggtaaaatctatttcagcaatgtccttagagtactggtgtgtatttttagctcaagaaaatggaaaaccttacgctgccattcgtttaccgattggctcacgagttttctgcattattactagatattgagaagagcagaaagtgaactataagagtaaaattataattatcattagtgatcatttataagtcacaagacactataataaacacatttatcttagttattttcacatatgaaaaataataatcatatgtataataaagtatcattcaccatatacaaataaggaaacaaaggcttagggatgtcaggcaacttgctcaggctaattcagctaacctgtggcagaaatgtttctggaatccaggtagactgatccaaagcctctgctccaaatgcatactccattcagtgctatataaagacatgactacaagttcaagataaaaagagaagggccgggcgtggtggctcacgcctgtaatcaaagcactttgggaggccgaggagggcggatcacgaggtcaggagatcgagaccatcctggctaacacggtgaaaccccgtctctactaaaaatacaaaaaattagccaggtgtggtggcgggcgcctgtagtcccagccactcgggaggctgaggcaggagaatggcgtgaacccgggaggcagagcttgcagtgagctgagatcatgccactgcactccagcctgggcaacagagcgagaatccatctcaaaaaaagaaaaagaagaagagagagagagagagaaatcacatctaagtatcctgctcagaccctcttacaccattgtcctattcaagtgtccatgccttattaatgtcagctaactggggaaggaggtattggggaaagaaaggccatcacagatttgggatactattgttatagctttgttctataagcttcttggagggaaaagtgtgtgtttccctaagaggggctgccttctacctttagcaggcagctttgatgcttccattctacatttacacataaatggacatgtatttcatattactgttgctctgactttgaccatccaattactggagaggtagagagtattatacataatattataatgccacattaatagagtttaaaatgtgctaacaattttaattaagataattatacatattataattatagtatatattttcttttactttttatcttttcaaaaggaaaagttaataatatcatggttctgtacttaatgaagcataattttgtttaaattatagaattatttcattctcccatccaccttacacacacacagacacactctagcacacacatgcacatgtgcacacaccctcttatccattcaggaagataagctttcacatccttagtagtcacattcttagttttcccaaaaaagaaactccattccatttatacttgtggaaatgaagtatataattgccatatgttctctaaaatgtcataaaaggtgaacattttcattcacatggaatatttaaaagctaatataggctggacgcggtggctcatgcctgttatcccagcactctgggaggctgaggagggtggatcacgaggtcaggggatcaagaccatcctggctaacacggtgaaaccccgtctctactaaaaatacacaaaattagctcagcttggtggcaggtgcctgtagttccagctactcgggaggctgaggcaggagaatcgcttgaacccgggaggcagaggttgctgtgagctgagatcgtgtccctgcactccagccagggagacagagcgagagtccatttcaaaaacaacagcaacaacaacaacaacaacaaaaccacaacaacaaaaaaacccgctaatatagtataaaatcattgtctcaaattaaaatatcaggttacaggaataaacaatgcagatgttacatacatttcaagatcgaattatttatttagattatttcatttaattatataaaataggtgttattatctccatgctaaagatgaggaaatgcagagtgtacagtttaggttaattgctcaagttcctaataactggcaggtaatataagtagggtttgaactaagcctctctgatcctcgtgtactcattcttaaccatgtatctacagagagcaggactgaggagcataatagaaaagaatctctgaaaagcagggctcagtagctgacactacaggcatgtgccaccatgccaggctaatttttgtattgcctgcctcggcctctaaaagtggtgggatcacagacatgagctaccactcccggcctctcctcttcgactttttgagagagtttgaggatttgtatctgttttctttaaatttttgatagaattcagctattagggcataaggtcctggtcttttcttgctgggagactttttcttacttattatattcccttgttaatagtttgttcagatgttctatttattaatgattcagtcctgttaggttgtatgtgtttaggaatttatccatttcttatacaatatccaattttttgacatacaattgtcaatagtattttcttatgatcctttttatttctgtggtatctgttgtaatgtctactttttcatttctgattttatttgagttttctctcttttttagttattctagctaaagtttgacaattttgtttcttttcaaaaaagagttactttttatctcttgtgttgcttttctagtctttatttcattttcttttctaattcgatatttattattttttcccatgtgctaactttgggcctagtttgttctttttctattaatagttccttaaggtgtaatattatgtggtttatttgagatctttttcttctttttttgttgtaggtacctattgcaagaactttgctattagaaccgctttttgctgtatcacctagatttgatgtgttgtgtttccatttgtgtttgtctcaagatttttaaaacattttcattttgattgcttcaatgaccttttggttgttcaggatcatgttgcttaatttccatatatttgtgaattttctaaaattgctactgttatgaattttgtttcaaacaattgtgtttagaaaatatacttgatataatttatattttttaaaatttgctgagacttgctttgtaccttagcatgtgatctattctgaataatgtttgtttgtgtgcttgagaagaatgtatacactgttgcggttggatgaaatattttgtttatctctgttaggaccattaaatctaaagtgttgttcaagtccaatgtttccttactgattttccatctgggtgaataaggtttttatggttgtcacgttttttgtttttgtttttttctttcagaactttgactacatctttccactctctcttgcttgaagactttctgttgagaaatactctgatagtaatattcaccctctttcatatatggtgtgtttcttatcacttgtcctcagaattttttcttgtccttgattttttattgttttgttattatatgacttgttgtgcttctctttgggttgaatttgattgaagaccttcatgctttctgtatctggttattggcatctatcccagacaagaaaagtttttaaccattatttctttaaatacgttttctggcctttattattatttgtctctttctggaagtcctattatgtgaaagtttaatctcttgatggtgtcccataattactgtaagctttattcctttatctttctgctccactgacaataatttcaaatgttctgtctttcaactcaagtagctagttttttcttctgctgttgaagttttctatggaatttttcattacagtcattgtattcttcatctctaagatttctgtctggttctttcctattgtttctatatctttgtctaacttcttgcaattttgtatattgtttttcaaattttactacattttatattcatattttctggtactccatgcaacatcttttttagtattattttgatttatctgctacagatttctagatctccatttctttagggttcattattgaagctttattagtttcttttggaggtgtcatgattccttgattcttcataatcctgtgtccttatgttgtctgcacatttgagggaatagtcccctcttggcctttacggtgttctctggcagggatacacatgcattatttaatctagcctctgattttggaaaagccagctggggacatccttggggaggcagagctttctgtgagatctctagttagtgggctattgactttgtttgggtgaggttgctctttgggctctgatggcctgtgggaacactggctttgtttggctataaagtggagttgctgggtgagtactgtgatggattttgaggtcagtcacaagatgtgtactctggtcagccaattatgttattggtgacctgaagttgggcagggctggaggctgggctccaaggttaggtggagtcattactctggacaggtggatccagaggctatggtccttagaaatacacaattaaggattttctccctgtcaatatggagccatgaagtggtttttttggctatgttgagaggatttgggactctttgggagggcttatgtgtggagtgaagatactacttgattttctaggttaagtaggtttagcccatttgcttctttaaaattcacagaagtgggaagttccttgcctgggcaaagtcactgggagtgtttctttgctgagtaaagctgctgcttgttaagttgccaagttaagctggtctagccccttcatttcttcaaaaagggaggagattggcatctccttgcctaggcagaattgttggggtgggtccctgaggcagggtgagttaaaagcatatagggactcaaactaggtgaaattttcaccatgctttcaaagacacctagctctgtactgcaggttggcaatgaggttgactggtatctgcaattgggcaccacagctagcaggaacacagtggtcccaccaagatccactcttgtcactgtggtctctgcctcctttctttggttctatttggacctgggtggtttagccataccattttgcctagagttccctgtgaggtaaggccagagtgggcttcctggaaagcatcttagaatgctagggacacatcaaaataaaaacatggtaaaacctaatcaaatattttccaggagagagggtgttttcattgcttgaccccaaatctcccttgacgagtatactgatggtcctccatttacaacggtgttattttccaataaacccattataagttaaatattatgtcaaaaatgcacttaacatactgaaccaactgaacattatagcttagcctcacctaccataaatgttctcagaatgcttgtgttagcttacagttgggcaaaattatctggcaacacagtatactgtagagtatcaattatttcccatcatgattgagtgactgactggagctgcagcttgctgctgcttccctgcaccttaagagggtatcatgccactttctattgaatacataacaccttcgcaccattgtacactcaaaagtttcatctgtatccatatagaatcaaggaatgcacccaactattgatacacgctatagggttgtgctgtaagattgctgatattttaagtaattatagaaataaagactatggagagaagaggaaagagcgagacagagagagagagagaggaagtattaggtcaactattgtgtcctgaggaactcttaaaagtgtactccactagaagaaaaagctaccaaagaaacaggaagagaaaagaaacaaaacaaagttaggagagtgttaaggaggtaaagggaatactatctcaaaaagaattgaatcattacctcttaaatactggtgggaaaccaagaaaactgagtggacttagcaacaagaaaataatgtaactacctcagaaaatttggaagaatcacaaggattgtgcaaatttagagaaaaatgaaggcaaagatatggaaatggtatctggaaaacaaacaaacaaacacaaaaaaacctttgagatgtttctgtgaagtagcagatacatggatggtatttagagagggatgtgtagtcccagccaaatattggtagagatgtgtagtaaatataaagaggtgtttaatgggaacaatttcatggagaaaatagagctaaatattaggaataaaaatatttatcaggcagaggcatatacctgagaagtcacaagtagaagagatggaaggtggggtcatgcaagttgggatacttcttcccattgtaaataaaggaaagaagtgcagtgtgagggcagattgggaggtaagctttgtagatttgtaggcaaaagaacacaggggaacccattaaataatctgtatcttctcagtgaaatgggatgcaattttatcagctataagaaaaagagaatgaataaagcaaagaaaatttgaaaagtaataaaaacttttctacaaaatatctctctaaaaagcagtttcctcaaaatatgtctaaagggaaagaaagtgtaacaaaactgtctcattgtatttataattagaaagcaatgaatttgcatcctgtttgtaaactttataatatttcctgttcaactttttttttcataaaattgaagttataagaaaattcccaaatggaagaaatcactttccctggagtgggtatgaggcttgataggaagatatcttcatataaagcagcctctagtctgagccacacagttcagttagaacctggacaagagacagtagaaaaaagcagtgttctcaagatgaacagcaaaagcaaaggcatgaaagtagaaaatggtaggatatcctgctgtgccaaactcatcaggggggcagagatgctatacttgcttctctttcctatcttctaaactaaagcatgtgtatgtatgttaacaattgtagctcctaaacgtgaagataacaatgaaaggaaaaaaacacacacacatatatttataactatatatataaaatgatatacatatatatgtatgtgtgtgcatacatacacacattcacacacacacgtgtatgtgtgtgtgtgcatatatatatacacagaaggattttctttctgtctgagattcgcttaaaagttggaaagatataaactgagggaattgatacttttttgttgttgtagcttgctgcatgtgcctattgcaacagtctttaagagtgcagaaaccacagaaatttaaagcaaatatatttttttttactacatggattcatggtaacatagttaatgactttttttcccctcagctcccctttaaactagaatctctttcagaggcaaggctgtctgtatttctttcagtgcaaggtacacaggtaaatatttcaaatgggttgaattgaatgcatgcataatttaaatgagggcagaacaaggggaaaacggcattgctaaagttttttaagctcgtgcattaaagcatagaattattttttacatctgaaaaattaagtctcattgtattcattgtcattactgactcctcctgactctgctatttgtccttagccagaccttcactatgaattcattatttttaagcatatatgttaaatcctcattaaatctatacagatgttaggttaaatttatttaagctacatatttcctctcctggaagcttttagcaatgtacctaatcaataaatacctattgaagttatcagataagcatgaatttttattggcaacttattagacagacatggcaagctacttataactttgaagcctggaaggctattctggtgtaaactcctgaaaatgattgtatttaaatctcatagatatatacattaaatcatggatgtaactgagcaacttaaaaagaataaaatctgaatcatacaagtttatttaaaaaataatttatcttcagatgtagctctttggttgtaaagtctttttgatatttatgttattgttttctgaactaaagtttaccaagaaaatgaaaaggaagggccatataaatgaaaattaaaagctataaatttccatagggattacattgctttaatatgtaaatgtgtaattatctaaaattaattttgctcatgtcaaatatttatatatacttacacatatgtacttatatacatgtgtatatgtatacacatgtatatgctctcaatatttattgtcattttagactgatatgaattcagatagagtttataataggtagagattctcatacaaatgttgaagcacattacaggctgaagaaattacatgaaaaacagaattttgtactttgtatatatgtgcacagttacagtctttagagctaaagtgagaaaaccatattcaaataaactcatccagaataatccccagcttttccaattttaaatataaaaagagaatagagtggtcaaaaatatctgcaagtgaatccaaaggccgaatttggtggtggtgagcttctgggaattaataacaccattggtcaggggaaaacttaaacacatagattcactctcagccatggtatcagaataccaatctttcttccctttgtcctgtccagaagatctacagtataaacataaaatgacttcacatttcactcaacagaagagtagtttaagacttccctatgtccaatacaaatttaacatgtgcaatatgactcagtgtttcagttttatcttgctataacataaaggcacaaagcatagtgaaaaaaatatttcaaagaaaaaacattttctgacttataaacatataacagagtctcctctccctgaccacattatggtttaaaaggatttcttatcaaactctcaccatagcaaagaaaaagaaagcttctcttaccagagtggataaagcttcaaccttgctatagcgttttctgcagctcttgtttgaaagacagatccacagcagctttgtgcatacaagtgatctggctgatctccagttcctgcacaaaaaaacagtataattggatctcaaaaaagtgttgtaaacattcatcatgatggcacttgcatgttgaatctagtgactgttattctggtagactttctccaaacaagcccattacatttctactttcaatacaagctgtttggtttctctgttcaatactgagattaatatctttaaagaaagcatgcatttgtgagtgtcagttctattaccatgtctgaaagtgtggtctaagattaaaaaaaatacacacaattataaatcaagatgatactgtctggtacgtaaatttacttagcacctatatgtctttatttttaaatttaacaatagtcaggccagtatttatgtactaatgagatatcagtattattaagtctctttcatttactatttgataaaactcaaatgaacattctatatctctgctttgcaaaaaacccacatcaataatgcttacaacacaccccagagtctgagaccagctctgctgcatttctaagtttcattaaatattccactgttcctttgcctaaaccttcaaagtggcccagacacaatcacatccttaaattttatgggagcaatgaagaggtcacaaagcattggcttttttgaaatttttaaacattcaatatttctggaagcattaactcattataactacaagtggcatattcttgttatcaaatgaatatgaacactagatcaaaaattaagtctcaataaaaatagtctcaatttgtgtcactctttataatgatctaagcaatacattgatcttacaactatatgattatataatctttgccttgcttcccatgggtttaaagcctggttaagcgttaccagcagtaccactacgaaaaatatgaattaactggatggagagattttttctttttgcatttttatatctggtatcttatttttcatctgtatacagattaagcaagtgcaacaaaacaattttgtgcaacaaaacaattttgtgcaacaaaacaattttgtgcaacaatttatgattgtagaaatctcaaaaaatgacaacttatgacaatataattcagaggattataggctgatatatgctagtcttttaagacaacagatttcattaatcttctaattatgttacttagggagtcagagtgtggggggagaagacctacatactgtttttttaatagtttgtatcagttaactattatcccttattattatgtaacaattgtctttataaaattttccactaacattttcatgtttaattattttattagaacagtgaagacagcattattattctccattatagttatatcatgatataactaagactcaaaggataaggacttgaaattcttaactagaggaacttctgatgttcagctacatccaaacaacgttttcttttaaaacaatgtatcgaatatttttctttaaaagaggtttgtgtgatttagcttggtgatttcaattggagaataggcatttagtgaattattgtaacatattcggagctgtgatacattgagaccttttcctatgcctaattattttggaaattatttgcaaatacagttcaaaaagacaattatatatgatgttatgttaaaaatgtttaaaatttaagaattacctattgattatttgctaagtgacaggttttttgttaagttctgaggttatgggagtgaataagctaaatatctccactttatgtaattttcgatgtagaaatgaaaataattagcccaagatataaatttgtttggaaaattttagtggcagtgagttaatttataaattcagtaatagacaaaaaaatccctaagatatcagaatttttatgtctttattacaaaaaattctaatcattattaaaaacagtattgctgaaaatattgagctaatcattttagaatgattctgaaattcttaatgcttatattttagaagaagattgtagacatttttactagttattttccaatgtacacaatttgtatttatatatacctatgtatatctacatatacaaatagtcatattaaggtcttgattagataatgaggtttggaacagttcaagtattacataatatggttgtaggagtaaatcaatttttccactaaaagttattgttgacgtccccctctctaaatgaatatattaaaaagaaaatgaggaaggcaaaataaaattatcataacatatcatattagttaaatgacttatagtatttatttgttctagttattctcagtctctttacaaatacaagaacacattgttttattgcaatttgctttattgtactttgtagatattgcagttttacaaattgaacatttgtggtaaccctgcattgaataaattatcagcaccatttttctaatacaaagtgctcactttgtgtctctttgtcacactttggtcattcacacaatatatcaagcttttccattattattgtatattttatctgtttcattatatctacgatcattgatattactcttgtaattgttatggggcaccacacaccacaaccatgtaagacagtgaaatgttgtgcatgttcagactaccgcactgaccagctgttactcatctttcttcttctactagagactccctgttccctgagacacaaaaatattgaaatttagctgatcgatagccctacaatggcttctaagtgttcaagtgaaaggaagagtcatggtctttcacttgaagtcaaatggtagaaatgattaactttagtgaggaaggcatgtcaaaagccaagataggctaaaagctaggcttcttatgctaaacagttaggcaagttgtgaatgcacaggaaaagttcttaaaagtgctagtccagtgaaaacatgaatgataagaaatcaaaacaactgtattacagatatggagacaggtttagtggtcaggataaaatatcaaaccagccacaatatccacttaagataaagcctaatccagagcaaggccctaattatctttaattctatgaaagctgagagagttgaggaagctgaagaagaaaagtttgaagccagcagaggttcgtttatgatatttaaggaatgatgccctctgtatgacttaaaagtgcaaagtgaaacagcaagggttgatgcagaagctgaagcaagttatccagaagatcagcctaagacaactgatgaaagtggctagagtaaacaacaaattttcgataatgaaacagccttctaatagaagatggcatccctataaaacaataaaacatgaagaaaacaaagtaactatgtaacaatcaatatgatgactggaacaatatgtcacatctcaatagtaacttttaatgtcaattatataaatgctccacttaaatgatacagactgtcagaattgatacagtaatcacaaaccaaataatgctgtcttcaagacacacacctaaccatgtaaggattcctatagactcaagctaaagggatagaaaaatatattccacacaaatggaaactgagggcaagcaggagtagctattctcatatcagatgaaacagaacttaaagcaacaaaagtaaaaaaaataaaaagacaaagaaggtcattatataatgataaaaggataatccaacaaaaagatgttataagcttaaatatatatatgcactgtagctcccagattcacaaaattattcctactaaacctatgaaaagaggcaaacaccaacacaatgatagaagcgatttcaacactccactgacagcattagacagatcgttgaggcagaaagtcaacaaagaaacactggacttaaactacactctacagcaaatgaacctaacagatatttatagcacattctacccaataactgcaaaatatacattattctcatcagcctacaaatcattctccaagatagaacacataacaaaccacaaagcaattctcaataaattttaaaaacttgaaacaatatcaagtatcttctcaaaccatagcagaatgaaattagaaattaattcccaaaggaatcctcaaaactatacaaatacatggaaattaaacaacctacttctgaactatgcttaggttaacaataaaatcaagatgaaaatctaaaaactattcaaaatgaatgataacagtgacacaagttatcaaaacctctgtgatactgcaaacgcaatgctaagaggaaagtctatagcactaaatacctacatcaaaaagtctgaaagatcacaaatagacaacctaacatcacaccacaagaaactacataaacaagaaaaaaacaaatccaaagctagcagaagataaacaacaacaacaaagatcagagcagaactaagtgaatttgaaatcaaaaatcaatacaaaaggtaaatgaagcaaaaagttttttctttgaaaagatgaacaaaattgatagaccactagccagattagccaagaagagagaaggttcaaataaactcaattagaaattaaaatagagacattacaactgacaccacagaaatagaaaagatccttcaagaccattataaacacctctatacatacaaactagaaagtccagaggaagtggataaattcctgaaaacatacaaccctcttagcttgaatcaggaagaaacagaaatcctgaacagaccaataacaagcagtgtgattgaatcagtgacaaaaaatttgtcagcaaacaaaagttcagggtcagatggcttcacagccaatttccaccaaacatttaaagaggaattgatgcctatcctacagaaacgatttcaaatgattgagaaagagggaatattcctaactcattctatgaagccagtatcattctaataacaaagacagggaataacataaaaacaacaacaaaaatactacagaccaacattcctgatgaacatagatgcaaaaatcctcaacaaaatattagcaaaccaaattcgacagcacttcaaaatgataattcactatgattatgtgggtttcattccagggatacagggatgattcaacacacacaaactgacaaatgtgattcaccacaaaaacagaattaaaaacaaaaaccatatgataatctcaatagacatagaaaagccattcaataaaacccagcatccctttatgataaaaactctcagtaacctaggcatagaaggaacatacctcaaaataataaaaaacatgtatgacaaacccacagccaactcatactgaatggggaaaagaagaaaacattccctataagaactggaagaatacagggatgcccattttcatcacttctattcaacatagcactgaaagtcctagccagagcaatcagggaaaagaaataaataaatacatccaaatcagaaaataggaagtcaacttatctgtttgcagatgatttgatcatatacctaggaaaccctaaagagtccttcagaagactcctagagttgataaataaatttagtaaagtcttgggttacaatatcaatatacacaaatcagctgcacttctatatgccaataacaaccaagctgaaaacaaatcaacaactcaatcccttttacaataactaaaaaaaatctaggaatatgcttaaacaaggaggtaaaagaactctacacctagaactgcaaaacactgctggaataaatcataggcaacacaaacacatggaaatacatccgatgctcatggactggaataattaatatcatgaaaatgatcatactgcccaaagcaatctacagattcaatacaatttataccaaaataccagcatcatttttcacataaatagaaaaaataattataaaatttctttggaaccaagaaagagcctaaatagcaaaaacaattctaagcaaaaagaacaaatctggaggcatggcattacctgacttcaaattatactacaaggatatagtaaccaaaatagtacggtactaatataaaagcagatgcatagaccaatgcaacaaaatagagaattcagagataaagccaaatcaaccaactgattttttttattattatttttattattattattattattatactttaagttctagggtacatgtgcacaacgtgcaggtttgttacatatgtatacatgtgccatgttggtgtgctgcacccattaactcatcattaacattgagtacacctcctaatgctttccctcccccctccccccaccccacaacaggcctcggtgtgtgatattccccttcctgtgttcaagtgttctcattgttcaattcacacctatgagtgagaacatgcagtgtttggttttttgttcttgcaacagtttgctgagaatgatggtttccagtttcatccatgtccctacaaaggacatgaactcatcttttttatggctgcatagtattccatggtgtatatgtgccacattttcttaatctaggcaatcattaatggacatttgggttggttccaagtcttcgctattgtgaatagtgctgcaataaacatacatgtgcatgtgcttttatagaagcatgatttataatcctttgggtatatacccaggaatgggatggctgggtcaaggatcctcaagttctagatccttgaggaattgccacactgtcttccacaatggttgaactacttcacgtcccactgacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatgggattgtttgattttttcttgtaaatttctgtgagttctttgtagattctggatattagccctttgtcagatgggtagattgcaacattttcctcccattctgtaggttgcctgttcactctgatgctagtttcttttgctgtgcagaagctctttagttgaattagatcccatttgtcaattttggcttgtgttgccatcgcttttggtgttttagacatgaagtccttgctcatgcctatgtcctgaatggtattgactaagtttttttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcagcgttatttctgagggctctgttctgttccattgatctatatctctgttttggtaccagtaccaactggtcagtgttgactggtcaacaaagagcaaaactctgtctcaaaaaaaaaaaaaaaggaatcagtcaatgtaaccaacttaattgttgttttattttcacaaattgccatggtcaccccaatcttcagcaaccaccaccttgatcagtcagcagccatcaacattgaggtaagaccctcctccagcagagagaattacaacttgttagaggctcagataatactcaagtttttagcgataaggtatttttaaattaagttgtgtacattgttctttagatataattctattccaaggttaatatattatggtatagcataaacataactataatatgcactgggaaacaacaattttatgggacttgcattactgcaatattcattttgcaggtgtctggaaccaaacttgcaatatgtatgaagtatatttatatttccactgacattatatatgtgtgtgtgtgtatatatatacacacacacacacacatatatacacatgtaaatttctgttgacacaataccgtaattatagtttcatgttattacacaggtttctcaaacataattatccattaatgtggatgttttctattaaagtgattaaactgaaatttcaacccctcattttgtcatagaagcatgctgaatagacctggagaaaaattcaaaatcctgacaattgttactactttaaattactgaccatgaataacaaatgaacactcactactgcaaaaatcttaattacaactgatggaatagccttaaacttcactgagaaaacaatagcccctgtgtaggagagcccaaatatcaacccatcccaactagctaccaaactgttttttttttgttgttgtttttgtttgtttgtttgagacggagtctcgctgtgtcacccaggctggagtgcagtggcacgatctcggctcactgcaagctcttcctcttgggttcacaccattctcccgcctcagcctcccgagtagctgggactacaggcgcctgccaccatgtcaggctaattttttgtattttttagtagagacagggtttcgccttgttagccaggatggtctcaatctcctgacctcgtgatgcgcccgcctcggcttcccaaagtgctgggattacaggcacatgccaccatgcccggcctgtctacaaaactcttttaacaaagttttaccaaactttctcatgctaattcttcttattcatataagttactccctctgcgttaattcatcctcatcggtgtttaatactgttttaatatttttatgctttcaaaaataaacccctctactacttcatttgtctctctagtaaccatatttctacattggaaaatatctcaaaatatttattttctcattttacaatatcttctcaactcgcttttatagaacatccatatcaccaaaggcactaaaatagtcctcattttacctgatgttctaacaattatgtgattccttcttgaatgattctcttctcgtctttagtggtactacattcttcttatttctttcataccatgcaaagcctttcaatcccaggctcatttgccggcttcttttcctctgaataatatgtttggagtatttcttgactgatcatggatctctttttcttctcaatctatactttccctgcagataatcttctccggttccatggctttacatataatctttcctgttgactaccaaatttaggtctgcaacctgacctttttccactgtgctttaaatatgattctccatctgcatactgatctcaattcctggctctctaacaaggattttaaaattcaaacacggcaaaatagaacaattgactctaccatatcgttgcaaatctgaccttactccagtcttccatatcttaacatggaattctttcagttaaaattctttgagttaaaatcaaagtattaaatttttatcttaatgttttattctaacaaaaatgcataacataaagtttaccatagtaactatttctgaggtacggttctgtagtattaagtatattcactttgttgcacaactaatctccagaacattttcatctttcagaactgaaactctatacctcttaaacaactccccaagaggaaagatttattgacatatgtaacaatacagatgaatttctaaattatactgagagaagctaaacaaaaaagtacatactatatgacttcatttatataagattctaaaaatgcaaacttatccatagtgacagaaagcagatcagctgttgcctgggaaccagaaaggtgggggtggaagaattggtgtgaggaattgcaaaggatcacaaaatttttgtgtgtaacagacgtgttcattattttgattgtcatgatggtttcagtagtatatacacgtgtctacacttatcaaatctcacactttaaatatgtgtagcctaatttatgccaattatactgcaaatatgacatttataataagttcacacataaaacctctaaaaattagaaagaaaataatccaatatgtaaaggcaaaaatatttgttcaaaatcttcacaaaataagatatccaaatgaccaataccatgtaagagaatattccatattatttctcatcaaaaatattcattcaccatatttagcaaaatttattaaaataatcatttcaagatttgagggaatgtgaaattcatatacaactgaaagaaccggaaattagcaaaagcagtttgagaaactggcaatacatactaatgctgaaaatgtactcatcttatgactcaagaattccactcctagtttcatattcaagaagtatatgcatatagcatcaaaagatacacattcgattgctcgacagctctctgcaacagacaaaaactggaaattatccaaatgtcctcccgcagtaaaactgatgaatatcttttaaaatatttacataatagaataaaatatatcaatgagaatgagcaaacttttgctatacgtgacaacatgagtgagtctcaaacctaatgttgagaaaagatgtaataaacaaatattatgtcttgtataattttatttatataggctgcaaaaatggttacattttattttggaaaaagtagtcaatctactgattatctttggggtagactgagtttaataactaggaagaggtacaaaataatctttcaaatattggtaatattttatttcctgttagagttatattaattatagacatgcattcactgtgcaaaggtactgggttgttcacttaagaatttgcaatttctgaatatgtgttatgcttcagtaaaactttatatgtatgtgtgtgtctgtatatatatatgcacacatatagctacacataaagtatatcacaaaaatatagaataaaatttattgtgatttatgttctttagaacatattattttttatgaaaatataacttgaaatattttgtgaacaattattgctaagacaaggacccattttttcctgataatgaaaacaaaacacgtgcataaggttaaaaagttccagtaaaaaaacaaagtcatttgaataattactcatcccaggaaagctgctccaattggcattggtaaagtatataatgcacttatttttctcaaaggaatacaccattatagcacagatatttatgtgtattcatttcacattatttatgaaacttcttgaggctctgacttagagaaagcaaccagctgtttttgtgatttgcaaaatgaatgtcttaaagaaaaaaaaggcaaaaagtagtattttatcatttatattgtcttattgcttttttactcactttcttaatatgaataccatgcattattttctacattgtgtactgttcatatacgatgaaaactgctatcaggacttaaaattacatcatgtaactcatatatatatatatatatatatatatatatatatatatatatatatggatgtgattagccatggtggaaagagtgtggatttcacaattgcaatgaaacagtttgaatatatgtaaatttgggcaagctgcatactattgccatggctctgtgtaatcatctatgagagggagatggtaatactaaccctacctgtatgcaaatgtaaacattatatgtaaatatataaaaattgatattctaaatgcttaccattactatgtcatgcactactaagaagttttactgggccatgcattactagtgttttacatcaaaagataagtttggaatagattgatttaaacattgattaaaagatgaacaatacgaaggctaagggattgtagaacagtgacccttcaacaggaacagtgtcctaaatgagtgtcctttttgctaaatgagcagcagcattctttttgtttgtttgtttgtttgttttgagatggaatttcactcttgttgcccaggctggagtgcaatggtgcaatctcggctcaccgcaacctttgcctcccaggttccagcaattctcctgcctcagcctcccgagtagctgggattacaggcatgtgccaccactcctggctaattttgtatttttagtagagacagggtttctccatgctggttaggctggtctcgaactactgacctcaggtgaaccacctgccttggcctcccaaagtatcattctgtttttgtaactgtaactgagcactttggcctcagtaaaaaagaatgactggaaacaacttggctatccaagtaacaacaattgtgtcaataaacttagtttagagatatttaccactaaataaaatctttacccttcatgagtaccagtttttttttaacttttttttactctctacatagacagtaaaataagttagagagtaaaataaataataagaatttatttagcttctcctatacagtaagatttgttctaacatttgtattggtgaatgagtattccaaaatgatatgtcagccatccaatatatagaccaaatacaagttgaacaatagtatagctatagatgcaaatatagatattgaggtaggtagaatgaaactattttttacaagcaatgtttgcctacttaggtgttttgtacttgctgatctctccaagtatactcctcctccatatactgtgtaacattccctcttaccacttccaggcttttacaagtgtcactatggctgagcttcccatgccctgcccattttccttcagcaattctgattcgcctatatgtttgagaccttttgctgcatgcgtctgagatgttgctttcattggccaatggtgcatgattgacatgcatacaggtcaggccagaaggtaaaaaatgttccccaaagcagccttcagttaattagagaagggaattagtagccaagtgcctcccatttccctcaatctttggatgataaaatatgagacatggttcacacagtctcccagaattccatagaaggatggagcctgggttgcctgtggcagcttcctgatcatttgtacactttttattggaatcctttccttctcagcacttgcctgtttcctgccatggttcttgggaatcaccacacacaacttacttgtacctaatttcttgcttcagagttagtttcctggaaatcttacctaagatagtcacattcttaaatgcaaaatttactttcaccaccctcattaaaagtgcaactccaacctaaaccaagcatagccttctccttaccctatcttaatatgcttcattgcattgttttgaaatgaaaaattatatcatttactctttacttactacctgaatccctcactggaaagtaaagctatgagagcaggaacttttgtttgtttgctgtatctctagtacctataattaaacctgctgaatggagggtgctcaatgaattatttttgaagaaataaattattaaaatgaatctcagcaaaaaactaagctaacatcaatattttcttctaagattgacaaagtagactttgaaattggcaaggagatagtgtttaactcaactttatgtgtgtttaactcaactttatgtttcttccccagacaaatcaaagaaatctgagtctaatataatgaatgttaaaacatacatttcattaaagctttgagtcttgcttaaatataattttaaattgtcaaggaaagccaagaattggaaccttctattttacaactcaaatagctaggcttcagatctttatcattgaggagtacatgattcaagcaattattaaatctacagatgttcagctataagcttttacaagatctcttgtcactgaaaagagagcagaggtatattgtagatgtagcaagaaaaagttagttgggctaagacaaaatgtaacttaatttctatcattgggggctacaaaacgtttaggtggtatgtaacaatgctgaataagtaaaataataattgagaacatacaatcaataattttcagttataatatttatggcaatgcctgttttcttatatactggagttttttaagaaagcatagtgagctttcaggtattactgtgaaaaaggaatagtatgacattatagtgtttaaagaagttttatttagatatgctttggttcaaattccaactctgcaatttactaaaggtatgctcctctatgatttcagatttacctaattttgtttttatttttagagaggtaaaacacataaggtaatgtgcacaactcttaattgtatagtttgatgtatcttcatgaagctaacacattcattgagacagccatttatcaaatcaaattatagaatatttcaaagatcgcaaaagcctgccttatgggccctaccaattatcactgtacccaacgactcggtggtaacgactcttctcacttctgtcaccataaaataactaagtctgtttttgaaatttttatagatgtaatagcacactatgttttatgtctaatttcatttggagaatattctatgtataagatttagtaccagtgttccatgtagtagccatttgagcattttcattttatgcactctcacattgcatgaccaccactaatggttttatgaccacatctaatttacccattccaaatttgatggaaatgtgagatatttttgttcattaataattattttgctttgactgtttaatgggtgcagagttttcttttgtggtaatgaaatgcttttgaactagatggaaatggtgattatacaacattaagaatgtgttggatatcactgaattgcaccctttaaaatagtcaattatatgtcatgtgattttgtcctgaagaaaaagtattgtgttgctttgaacattgtatctcatttttgccctatttatactgtgaagtattcatatgttcagcgttagtagaaattgccaacttttctcggcggcagtgtcagtttccacattcactgagagtaaatgagatttctagtcctccacaacattgtcaacaggatttgttttttcccatactcattggttttaatctgtatttcaccgatgatgaatgaggttgagcacctccacataatttgattatctatttagatagatttgttagtgaagtgcttagttttttattaggttgtcttttcttactaatctgtataaatgtatgtattctaaatcattttttctcagattaacacattccctgacaattattcaaattgtcaaaatattctctcattctgtggttttgagtttcacagttttaatctcctaagagtgaatagaagttcttatttttaccatagttcaattttccaatttttccctttatacttagtgcttcttgagttttgttaacatatatttaactatatcaaagtaacgactatatcttgttattttctggagttttcattgtattaccttttacatttgggcttaagatccttggaattaattaccttgtattatgtaacctggtgatcaagcttctttctttttctatttttccttccttttttccttcttacacacacacaacacacatttatctgtatgtatgaatatataaatatgtgactatacacgtaatacatatgctttcttacatacacgtttgtatacacatatgtatgtttttatccatatgtgtgcacatgtatacatttatgtattcatacttttatatatgagtagatatattgcaatagatatagtataaatcatctttcttctacattaagtgttattttgttatttttgtcatatatctggtaatttatgagtcagctatatcagtcttatttggttcctttgaaggtgatgtggtttggatgtatgtctcacacaaatctcatatagaaatgtaatcgccaatgttggaggtggggcctagtaggaggtgattagatcatggggtggatttctcacaaatggtttagcaccattcctgttggtactgtcatcatgatagtgagggggttcttgtgagatctggttgtataaaagtgtgtgtagcacctcccctcttgctgtctcactcctgcttttgccatgtaatatacaagctcctgcttcatctacctccatgattgaaacctggcagaggcctccccagaaggagaggctactgtgtttcctgtacacctgcagaatcatgtgccaactaaacatcttttcttataaagtagccagtctcaggtatttctttatagcaatgtgagaacaaactaatacacaaagcattatgcccttcctttaagctccttttgtagatttttttcctttgttttgattttcaacaggtttactataaaatggctagattttctttgtacttgggattcttgtagcttcttcaatttttggtactatgtcttttgtcagatttgaaaaattattcacaagtggctctttgattttgtgtttgcctattattttctctttccaaaacactgagtatatacaggtcccattttatggtctctgttcttcaagatggatagtctttgattaattcattcttttaaaataagattatacattaatgctctctttttcaaagccagtcttcttctacacccacttactgaattatttattatggttatcaaaaatttcagtgctagggttttcacactaaacacacacaattttaattatagttctctgttgaaactttcaatattctatttttcagcatgtattaatcataattgtttaaaagtctgaatttcatttcaatatctagtaaacctgagtgactattctattacttaatttttctcttggttttcaatcattcgacccctattttctagtagaatcaattatttttatttaattactggccagtagaaactcgtgggcaaatcacctgattcagttgaggctgacctgtttcttgtttgtttttctacaaggtagagctcttctggcatccccactgaaagtgtgcagtactaactagggccattcttttttttttcttttttttttatatacttttttattatactttgagttctagggtacatgtgcacaacgtgcaggtttgttccatctgtatacatgtgtcatgttggtgtgctgcacccattaactcgtcatttacattaggcatatctcttaatgctatcccaccctcccccaccccacaacaggcccctgtgtgtgatgttcccctttaactagggccattcttgcttattagtacatgaacttcaactcttgacttccttgtcttgtgtgactgccaggttctctgcttggtttgtagcagctattttcttcttaatttctatttatttagtctatgcatttgtgttttagggggtggaaaatgcctcaaagtaaattacacatgaaatactgggctcaattttctacattttatttttcttctagaatattggcttcctgaatatagggccaaattattgaaaaccaagagaaaaattaagtaatagcatagtcactcaggcttagtagatattgaaatgatcaaacacagacttttaaataattatgattaatacatgtaaaggtactgcttagtaactttgactccagtgtttgtctccctagtccagtggatttattgtcaactgtagactgtatttgtctattcagactttctgtccaagccatggattagcaaaaaccatacagaaggggatggaagagaatggaggtaaatgatgggcttgctacaatgcatattttctctctctgatcttgttcctccaatccttaattgcattgaaatcttcagtcacatgagttttgcatttaaaactcttattgttgctcttcatgagggaataagtcttatatctgttactatattatagacagaaatgaaagtctgagaaagttatttaaactctcctggtttttcttcctttaaatgagaatgaatatgccactcaaagtgtatatttaaatcatagttaaggaggtttcttatacagagtgcactgcagagtacattgtgattaataaaggatagaggttatgattgttagtttggttcattaataaataataactaccattacaatgtcagaaagtatacggtactcaaatataaaatatatgaaatcataataccaagaagagagttacagttttcagtagaaacacaaccatatttctataaatattgtttattaagttgttctattcctgaaacattctatttatgtaaatattctggactaataagggaaaacttcacctagtttaagcaatttggtgagaactcattcagctatgagtaaaagaaacttagaagtaggaagggggtaatttttttcatgcttcaatatatccagtagcaagtaagctagaccagcatggtgactcaaagatgacattgagaacttgactctctcaatcttgcagctccgctatttacactctttggcttttgtctggtcttcatgtttgcctcttgttgacaggagggacaagtctcctccagcatcatgtatgcaatataggcaagaatgggaatttggcagcaataataagataattattcttatgtcgggaaaacacatttccccagaaattatggggacttttgcttactagattcttgcaagaactttatctataactgtaaggactgtgggtatatgcagcttttaagctatgagtatcaactctccatatcaaatttgtcccacaaatatactcacacttgccatgcaccaggattagattcttattatctactttattatttctcaagttaccacgagccacaaaaagaagctggcatggccaaacacattagggcattacttacatgacttatatgatgatgttttcaaagagccaataaaaggctcagaaaactataaaggaaaaaaataaaaagttgttattttcctacaattttttccagaaaagaaactaagttttggtaaaatgcctacaattagagcacagagctactaatctttaggagaaaatcagacaattattgatatgtcataatttatatgcaattattacatcctttttttttaagacagggtctcaccctgttgtccaggctggaatgcagtggcatgatcaccactcactgcagccttgactttctgggttcaagcaattctcccacctcagcctttcaagtagctggaactacaggtgcaaactgctacacctgattaatttttgtattttttgtagagatgggttttgccatgttgcccaggctagtcttgaactcctgagatcaagaaatccacctgcctcagcctcccaaaatgctgagattacaagcatgagtcactgtggctggcctcatatatgtaactatataaaaacatgaagattgataggtagatagacagacagacacattgctacacaaaagccagaaagattgtatttgcacatcagttcaaacatagattttatatatcagcaatgaaattaataaaatatttattgaatacctactggtttgggcactggagtagtaagcaaagagcaaattcaatgatatggggaaaaatttaataacagcgatagcagtttggttttccaaaatcacaaattcagaaaaatataaactttctgaagtttgaagacattcatatgaaatctgtgtaaattcaaggtccaaaattgagatatttaatccaacaaattttatgttgtttctttctcttaacattattttgtctattccctcttttctcctaatacattttttcttacatattactagatgaattaataatgcaaagaggctggtgctgcttttaagttgatcactaagtcattttattatcttaattttagaacattttcaagttacctgcttgcattgattgtgaatccttttatttattatttaatttaggatgcccttgtatcattttaaaacctctatgagtttaggaaaaaatgtgggtagtggtgttagtaaatgtgtttgaatgaaaagaaattagtttctgttctattccagtatcaaataattcagcaatatatgcaggatttccttcaaaggtatgttccaagtattcagcacaattctctgtctttccaaaaggcaatgggtgtatatactaataaattaattaaatcactccttatgtggggaacatctatttgaggaaagtttttgctcctctagatgaggttgaccctagttcagtttctattgccaaatatatgtccttgttaaaacaggaagttttaattctttcattttatgttatagaaaagtggtgctttttaaacttctatttctgaaaatacagaaattaaaaataatttaaaaaggaaactctttcttcacagagccaatgaagcctttctaagcataattctctgcaactaaaacttgaagaaaagaacttggtgataagcaaaaacacagaagtcccacatttacatcttaatggactctcttaatatgtgttcaaataaagttacagaaacaataatgttaaattagacaatatgcaagtaaagtcaaatattaattttgtaggcaaaaatgtgggataactttgcaaattattttataagtggtatttttcaatgtttagattattaatatctagtttctaaacagccaggtgtgttcctaccattattcgcaaggtctggtgtggttctttcattcagtaccctgtcaaaaaagacaattttcaagacaagatttataacaaacgcttctaatgttcagaaaaaaatagagtattacttgaactgataaatcttcttaaatattaaagaatatgatacatctactattaagcactaggagaatttaatgtaagaaaaatatgcttaaaaattacgattagcatgagaaagtgttttaatatatccttcctattcctcattcttctcattaaggtaattacaaataaacgtttgttttatttaatttattgaggatatatttcactaggctggaagacaaatgctgaagccaaattaaccaagctgccagaatgttagcaaggcaatatctattgtttttaacatcgtcgtcatcatcatcatcatcatgatgttacagagaaataaggataaaatctgataaaaaaaatttgggcagcggaagagccacataatcaacgttagttatcgcataatctttattaaaatgagtaacagagaacttaaataaactacagtcatgtggatagtaaatggcagcctggcattcagatctatgtgtttcaaaaaccatccttgtaaacatgatcatattactgcctggagctaaatgattcagtttatctaaaggaggacttaccaaaatctagcatctagagttggagagatctccctttggcattgagttctgatattttaagagttttttcattatagaatataatctgataaagtaagagatcataaactagaggcagattttaatctattttttaaattttggctcaggatatgtcgactttagctacttctctttaacccttttagcaaagaaagcctgaaaagggggcaaatttatctatataatcaggagatactggtaggaaacttgagaaaattaggttgtcccagctaaaaatgtacattttaaaagatgcatgacataaaacttatagaaatcttgcattatgagctctctatcttacatcctgtcaggaagggctatcagaaacttcaccactacctggtagaataatgttttccaaaatgaatctaatgatatgcactcaactagctttgaaagacacccccagggagcattttcaaaagccggactcctggatcttcttcctgaataattgagctgaaatctcagatggtccaggacgtccctatttcaagcagcttaagtgattatgacagttatccagttgagaatccactgttcttgaatacataaatactttttctagtatattgtacattcagacaagatttattttattttttcctttgtgtcattgaatttaatatatcatcctttttattataatagaattaatttaataactagtcaactacttaacctgctatagtgctttcttactccattcaggcatattatttttcattatttaactttcattacttgcttttccaaagcacataacatacagaattagtgggaggcagaatgcaaattaatacccaatcctatttacctagtaaaaaatacatataaatgaggattaaaacaatattttaaaaataatagactttttaattgtctcagtgtaaatgcttgattttatttatgaatagatttattcagcttagccataccataatctaggtggaaagacaatgttatttctggtttactgttgtctctttgctttcaggtcatgataaaaagaatatatatgctggagactttttcatgtgggaagttattttcaatatagtttagctgaaatgtcatcttagttttaaagggaaagaaaatagcatgttaatttattgagcaagagagacttctagtcacagactttagactctagaggctgtggcttgtaatgaagctgtcagcagttgctactatgcctacccactaaataaatgatggcatttctaggaaaatcaaaacatattgctttagtagaaccttgttaagaaaaacaaaataataataaataaaatcacaagttttttttctttcacctctctctaacttcatgtgcttcagtatggaataatccatgtaaataaatgggaatttttatttttataaaatacttttaaagacaattttttaatttgataatttttaagaactcaagattaaaagtcagagaatcataaattaaaacttttttgtcaatacaaaacaaaaagtaaaactaaaagacaaatcactaccaacagcaaataatacaaaataactcataaatctctgaatcaactattacctttaaaggtgacaatatgtcattagcacctaaagtattttagcagctaccttaaatttattttagaagaaaataaaaaaatacttaaaatcattacagacaataaaactaagccatgcctgatttttaaaaatttttatgttgttctacatctccatcaagttgtctagccttcactggctcagatgcctaagttgtctgtataaggatttccacaccttctctaaagttctcaaaagtgcaatcagccttttctttggtaatgtcagattcctacctggtttctcagttctcagtatggtattatcctgaatctacctcagctatgttcctttgggctgtatttgcatttaatatttattcacagggacagtcataattctccatttggaagaatggaacaagaatgtagaaaacaattatatgctgggtgcactatgtgtgctagccactatattacatgttttcacatgaactcagtttactcctcacaattctgaaagaccgtattaagagaatgaagaagaaacataagcagttataacctatgcacatggaatgaatatcacagtttgcttttaaattgagtaaattatttttaaacgagtaaatgataattatctcacaaaattactaatttcagcaaggcatttttttctgtttttgcaaaagatatttatatgaacatttattataatgtatactatacttttaggattatgaacaccaatgccaggttaatcacatttgactccagttttagagatagtaatgcaagaaagggtgaggtaagtttttggatgccatttccagtgactttattttttttttacttttgtaaaagtaatttttcatcatttccataggctcatcactacactcgcttcctagagaagaagtctaatgagaaggcattttgagaatttatgccaattctcttatgtgtatatgcttatgaatcatgtaggtataactgtagtaatagaacatgtatattataatacatatacaaaatataagttttcaaaagacgagataaagtttaatgtaaaaaacattaataaacatagctttatgctatctttattagcataacatgtttctaaaatgggctccaaaattcctgctcctggtgtgacacactgtataactctcttatcttgagtgtgggcagaatctgtgaatagaatggcaatatcactcccatgataaggttcaaatcagttgacttggacttaaccaagagggagcctatattgggtgggtgtcagggagactccctctggtctaaagcaggcatttgcagtttacaaccatgttgtaaactgcctatgggccacataggaagggtctgcaggtggccactagtagctgagaatcgttactcaccaatagctagcaagaaaatgagaacctcactcatgcggtcataaggaaatgaaatcttccaacaaccagttatcttagaagagaaccctaagtttcagatgagaattataaattatttatgatcctggtaatacgctgagaaaagaagcccccccaaccttccccgcccccactcacccacagctttacccgccccgccccccacccacccacatgcgcatacatgaaagctacagggttcctggatctgagcaacttgagttaaggggaagtatccacaatcttacctacagaaacaaacccctttcttcttgtcctctttgctctactctcaccctaggacagcaaggaagttgatgcctaaagggattaataatttcatctgaatatgaactaaattgacactaactcttaatttgaataacaacctattattcaatgacttccaatgttaacatttttatttcttatattttatagtattcagacatctttagtaaagtattgatgctgtactaactttgtagatttgtaacgcaagttcttcaaacctaagaacattttgaggcgttggtgtgatggtgcccacccacgcagacacttaaaaggctgaggtgggaggattgcttgagcccatgagtttgaatacagcctgagcaacatactgagaccccatctctaatgaaaacctcaaaaagtacaaaaaaagttgtgagtggtaaaacagctgagtttgtgtgaaatacacctgggctccaaatacttcatcctcctggggagaagtcacagcagatgattaggcaaactctgtgctatgttaggattaggtaaactccttcctatgttaagagtatactgcctaattcaatatctcaacattttgtggttatgattatgaaacctaggaaaatgaagctagacccacatgtagtagttaggcaaattgttgtaagtaaaacataaataaaagatagtactttatgaatatcacattaaaacttattattaataaatggtatttcttctggttgaatttgtatggcctttttctgaaagacttcatattgttttaaagtatttgtgtcaaattgcaggatagcatgtgtgtgtctgtatgcatgtgtgtgtctttgtgtgtgtctcccttacctttaataataaataatagcatcttaaagatgatatatatatatatagctgactcaagagtaagaatatactgttagtttttttcttccctgagaaatgttggtcataaatagagtttgagagccactagtctaattcacgacagttaaatttaaatttattttccatgccatttaaaaaaattaatactaaatgtcaatagtaaacaaggttatgacagaaatagcccactttttaaattacactcctatggcaattatgtcttattttattcaggaggtgagggaaacatgttaccttaacacaatgcaagagttttaaagtcttgtcattttttaaatgtcaattcttgtttcctatactccttaaaatataaatatttattatgcttcatggccttttcatgttataactctctgaaaaattataggtctcaaagccattcaagtgtttatcatgggaataggtatagatttgacaaacagcataaaatacctactttatatatttttaattatttttgcaataaattccaatgtagggaagccaaataaagcaaatttttaacaaaatttacacatcttcttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggttaattttttgtatttttagtagagacggggtttcaccttgttagccaggatggtctcgatctcctgacctcatgatccaccctcctcggcctcccaaagtgctgggattacaggcgtgagccactgcgcccggccacatcttcttactaatagttatatacatactataattggtctcagtgaacaattcttttggtgggcttctacatttcaatagaaagaaaatccacagcagtattaataaaggctcataaagtgcactaagaattctaatagagacaaaaatgttcattatttgagaactttacagaatgtaataaatttcttaaaaaattaaaatataatcattaacagtttaacaaaatgggggtggtcagaattttagtttataaatgaaatttatactgagaaagtcagttttgtgctgtggtgaatatttgaccttccactgtccctagaataaggtcatatagcatgaaactctatgtcagagattagcaggctttctcctttatttctttttgtaacataagggagccctgtaccagctgcatgcagcattacttcatgagtgtataactgtatttaaatcatttatatattacattttacaaatgtaatagggaaatgtgttcttttgcattcatggttaagagttggaacagatggcgaaaagctcagcttaaactaatatgggcattaaaataactgatattgcatgcattccttgatataacagaagtttagttcactataaaatgggcttgtaactttctagaatatattaaacataatgtttctttagcaacaattttttccacattaggaaatttcctgttaggatgtatccagaagagtttttcaaagttaaagaatgtagtaattcctttaacaaatatttactgagcacttattattttcaggcactgtgcttaatattgagctgcttaaaaagatgaataagacacagttcctgccttcaagataagaatatcatcagatggaggagatggagacattacaaaacattgacaacacatggaacgtttgaaacacctttgtattagtcatggttctctagaaggacagaactaataggatagatgtatatataaaggggagtttattaaggagtattgactcacacaatcacaaggtgaagtcccacaataggatgtctgcaagttgaggagcttggaaaccagactgggtcccaaaacctcaaaagtagggaagccaacagtgcagccttcagtctatagctgaaggcccgagaggccctggcaagccactagtgtaagtccaagaatccaaaagctgaagaacttagagtctgatgtttgagtgcaagaagcagccattataggagaaagatgagaccggaagactcagcatgtatgcgctttccatcttctgcctgctttattccagctgcgctggaagctgattacacggtgtccacccatgttgacagtgggtctgtctctcccagtccattgactcaaatgtgaatctcctttttggtgacactctcacggacacaaccaagaacaatactttccatccttcaatcaagttgacactcaatattaaccatcacaacctccatttgtagtgactgggtctgtggtatttccataccacccagaatctgagccttcaattctggcaattacaaattgtcaatggagcctacatctggagcccagccgggacaccctgtccttttgtgtagggatggatagctgagaataaattaatttataactcatacatttgctatatcctttccatcaaataacagaagagttaaagaatttctttaaaaaatcaccattgagcaatcatttgaaaatataaaaagaccttttcacataatgaactactctaccagctatagtcttttgcttgggatcttatcttgcatgtaatcatgccccaagaagactattttagtcatatctttgaacaaattcttgcaaggcccaaattctattaaattttctatagttcttatatgcatctcaaatttcccattcctctaggcttttctaatgtgttattgccctggccaaggacacctgcaaaggatcattcctaatatcttttcgtgtcctttatctttgtaaactcctattcatgcatcagaacttgacttaaagatcactttttcagggtatatcttccctgacatacaaattaggttagattcacctgaaatatctttatttaaaattcttcattttaagaacattcatttttatttgttttaattccttgcttaacacccattatgtgcagcaagaaaacaaacacaataattagtacataatgaatacagtagagataactctaatataatcttcctcttatattaataaaacactttcttactttgctatgttttccttatatccatttctactggggatattgtctaaaatagtgataggtgaaaaagaacgcaaaacttaagatttaaaatgtatactaaaaattctttatttaaatgaatacattatagtctttcttgtgattcactagttatatttacttccttttgctatttcagaggtgttgctgttacttaagaaagcagcaccacagagttaatgtgtttttaatttagccagctttctttctgagtgctttttaagtttggttgataaaccaatctagtttcttcacaggtactgccatactgtaagatagtacttcgtgaggagtagctttacattatttttttccttgatgcctcactgatgattccaaataaagtttactgggtaatttggagaatatggggcagtttaaccacacagaatgtcatacaggctgctgctgagtcttttgctaatctaagcaagctctctaaagttagaggcaaactgtttacttaaaacattaaagaatcattttgcagtatttaagtaaaaaggagtaagcagtgggaatagagaaaattgtatccgcagttcttaaaataattttatatcaaaatcactggatatggaagtcatgatcattaaaacgtgcacacctgcttatatttgattgtaaccttatatttgattataaccatctatattctccacatacacctaattcacctgcactaaagttttgctttgatgactgtacattcaaatttctgcagatgttcttagagcatatatttatgaaaataacatcctaaacaatcatttaaaatttacttgagtgcaataactgtatgtaggcaaatatattcatttctttacaaataagcatttattttgtttattcaattagatcttttacaaagggagtctagtctataaaatgttaacactgacttaatattcacaaaaagtatattaatatttctatattaactatgaaagataaattacattatgtattgaatactaatatcatttcacttatttttgacaaacaagcgtatgacttctatgtaagagttcattattcatatatgaataatgcattatatttatatgatatactataagattctttgatattcacactattttgttgggttgttctagaaatactgaacattagtagaagtgctactagccctatatggcaagtaaggaatccgaggctcagatcagttagataatttatcagaagtcaagtagctagtaaacaattaggtcatagattaactctgggctttctgttttagtggcctgtactctctctccactgaaaaatatttttattcaataaatgatgctaaaacaaatggacattacattcaaaaaaatgacttgagacataagccatatacccttcacaaaattaataaaaaatggataacagacctaaatataaagtgcaaaactataaaactcctagaatataacataggtaaaaacttaaatgaccttgggtatggtgatgactttttagatacaataccaaagggaataatctatgaaagaaagaatagagatgttggacttcactaaaattaaaactcctgctctgcaaataattctgccaagaaaatgaaatgacgaaccacagactgacagaaaatatttgcaaaagccatatataataaaaggccattatccaaaatgttcaatgaagtcttaaacctcaacaataaaaagcaaaaaacctgagttaaaaaaaaaatagtatttggcctgaacacacacctcatcaaaaaggatacacagatgacaaagagcatatgaaaagatgctccacaatatatgtcttttggaaactgcaaaattaaaacaacaatcagataccctgcaagcctattagatggtcaaaaattcacaacactgacaacactaaatgctggcaaggatgtggagcaatgggagctctctttcattggtggtgggaatgcaaaattgtacagcattttggaagagagtttggcaatttttggtaaaactaaacattctcttaccatataatccaataatcatgctccttgatatatacctaaggagttgaaaatacgtcccatcaaaaacctaaatgtaggccgggagtggtggctcatgcttgtaatcccagctctttgggaggccaaggtgggcagattgcctaaggtcagaagttcgagaccagcctgtccagcatgatgaaatcccgtctctactaaaaatataaaaatcagccaggcgtggtggcaggcgtctgtaaccccagctactcgggaagctgaggcaggagaatcgcttgaacccaggaggtggaggttgcagtgagcagagatagcgccattgcactccagcctgggggcaagagatcaagactccgtcaaaaaaaaacaaaaacaaaaacccaaatgtggatttttatagcagttttattggtaattgccaaaatttgaaaacaactaagatgaccttcagtaggtttatggatagctatactgtggtacatccagtcaatggaatattgttcagcactaaaaataaatgagctatcaagttatgaaaagatttggaggaaacttaaatgcatattattaagtgagagtgaatctgaaaaggctacatagttactgtatgagtcctaccatttgacattctgataaaggaaaatctatggtgacagtaaaaagtcaggtgattgccagagtgttgtgtgggagagggatgaataggcagaacacagaggagttttaaggtagtgaaattgttcagtagaatactataatggttgacagatgtcatcaaatatttgtctaaacccagaatatgcaacacaaagtcagaactctaatgtaaactatggagtttgagttactatgatgcattaacgtaggcttgtcagttttaacaaatgaaacactggggatgcagataattgaggagtctatgcatgattggggcagggaatatatgggaaatttccatactttccctttaattttgctgttaatctaaaacattttcttaaaaattacttttatttctacatgatgcttaatatttggaaaatcacataatttctataaatttctaagttgtataatttttactaatctgctggtatttatgtgaatctgctacataaaatatgacattgattattttgttttattctcatataaagaaaatgaggttttgctatagttaatgcatctcaagatggcatataatatagaagactagtagttttctctaaaataattgatgcagctatagactatattacttatagtccttgaagctccatatgaccaaagactagcttaaggccagggaaacatgaatagaagcaacatgttctacttcctggccatgttcttaaaagaaaagaaccttattctttctctctcctctgcaaattattagtatgtacatgtttgtgagagtcagaaaagcattctggacccagagaaagaaatatttcttagaggatggcaaaacgacaacaaattaaacaaaaaataaaaagccaaagttaaagaggcacagaccaagacaccatggagtaggtccacgttagcatttgagaatacctttgcactgtaatatgaaagagaaaattctatcatttataaccaatgttataattgggcctttgtaatagcatccagagactatattctaattatatacacacacatacacagaataacaaagggttaaactaattcaggagttgctttttttatgtgttataaacattattgtaaatacagatataatttagatatatatttattgcaaaaataaatgcagattttcagatggacaatttaatgaattgataacagctttgattgagaaatgtttatcctttttactctgtttaaatgagctttctctgaaaacagctttctcttcaattaagaaatgtttatcttttttactctctttagataatgtttccaggattcttgagataaagggtaatggtttctgttgattccaagaaatctaaatctaccatgcctctcaagccaaaaccagttacatggtagattgacaaatatcaaattaatttgaattaaatgaaaaaattaagggttatttaatttgaattagctgctatctttttccacatcattaataatgttggaataatcaatgcttctatcctctacctcttctattctctacttacacttacttctattttctagctatacagtagcatgtctcaaatgaatatccacagccaaaaattatttctttaactcaaaattcatatgccctactgtcttcttggcttttccactaaatatatctaaaataaaactcctcattctttccacctaaaaataaaggctactacaaacacaaccatccccatgttcattgacaataactccatccttctagtttttctgtccaataaccttgcaggccaaaccttttcaaatcatttttttttcctttccttttcaccttactacacatccaggctaccataaaatctttttgatcctagtttaaaggttttccagaacacagcctgttcttcatatcttcattgctagcacagtgccccctatgtcattttatcttcccagagatttttccatagcttttcaactgatctttctctccaccccatatccacacataatatatctaaatgcagaagtctgagttgttttttttcttaaatataagttggattatataaatcccctattcaaaatgctgttattgcctatccctttacctaaaataaaagtctaaagcttttaaatagcctataaagccttacatgaacataacccttgttatttctccaactttctcttctacaacatttccccttcctcggttctaaccacactgagattctggctgtttcagacatagcaagcatattcccattttattacctttaccccatctttttctctgcctagtgtgcttttcttctagattcctatttcactaactgcttcaggtcccttaagtctttgcttgaatcttatattcccaatgaacactgttgtaaattacatttttaacaccacaacttatccccagcttaccatctgctctttggattctgtcaattccctctagtcttttttgcttatctttgttttcataacataaatcacctcttcacatattatccaatttaattattttgtttgtcattcattgtctcttacctttcccctcacataaccagaggattaatggggcttgttctttgatgtatcctatggcctaaaacacacgatacttaccaaaaagtatttgttgaaatatacacacctgctgtatttagtcatactactgtatatttttaaatatattatatcagttaatcctgtgttaggcaacttctagagggtttcaatgatccctgctttctgatatttaccctgttgtgtaaggcttcttgttgagtgtgagctgtacctagagaattgcttttaatgaacagaatatggcaaaagtgataggttatcacttctatgattgagttatgaaagactgcgacttctgtcttgctagtctcatgtcttttgccagcactctctcttgtctgattcctttctctcataaatcaagctgtcatgttgtactctctggataggcacacacagcaaggaactgaagaagtcttctggcccacaggtcatcagcaactgaggcctcagtacagccagcaaggaagtgaatcttgttaacagtcatgtgaatcaggtaagagactgttagattggtaccaaagtaattgcggtttttttttcccctgaaagtaatggcaaaaatggcaattaacttttgcaccaacctaattttttccaattgagacttgagatgactgtggccttgtaagagcccaggtacccagggaattagtacttagattcttaacccatagaaactgtgagataactgttatggttttcagccatgaatcttttggattctttgctatgcaccagcagatgaccaaaatgatgatcaatatgaaaccacatatttgcatgaagaccaaatcctcctatagaaactgtgggaactaagagtgtttttgtttagtttagtttagttttttctcagtatttttatttcacttagcataatatcctttatggtcatccatgttgttgcaaaaggtaggatttccttttaaaagcctaaatagtattccgctgtatgtatacaccacattttatttatttatttatctgttgttggaatttgagttttttaatattttggctattgcaaaatatctaaattatctaagttaaggtttagatactgcttgcttacaagcagaactctaattttattttctccaaaaagtaatgttgctacttaaagaactctaatttacagtcttgcttacttctagaggtgaagaaaagaagtcttccaggaaagatacttatgtacagctaagtcatatggaaatagtaccctttggttctctctcttccctttttttacttatctgaaatgaaaatatgaggactgaacttcgactctatcttgggtgacaagaagaactgaagtaggaaggaatcctatgctaaggatgagagagaaataagacagcccacactccactcccttcccccaacaccaaatgtgagcctatcattcaacccacagaagactttttataaatgagagagaaatgaatctctaatgtgttcttgcagcttatttgcttttttattttaggaattgaatcttattctaaactgatacagtgtctctatttactttgctttggtgtcctaagtagaaactataaatactatttagacttattgcaataggcaaagggcatattttaaatcatattatggatatctgcaactgtgtatcttttagttttacagcatgtattgtcatagttattattgtaatcataatgcactgaaactttacatcattttcaaccatatactaatagcgaaataacataaatatgttattttctctttctctgctcctctccgtatctatgtatttacttcctttatattattcttaacttcttaggtgaggaacaatgctttaaatgaccatggacttcttatcagacatttatgacagccagaagaccatggaacagcatctcaaaagtactaaaggagagccacaaaaccagaattctatatctagcaaaaatatatttcagaaatgaagacaaaataagaaaattatcaggtgaaggtaaaccagaaatatttactgttgacatatctaaaagaaatgttaaaagaagttttttaggctagagggaaataactaacaccagggggaaatatgaaccttcaggaataaagaaagaacaacataaatggtaaatatctagataaacataaaagataatttttctacttttagtttttaaaaaatatgtataactcttgaaagaaaacattcttatctggtggagttttcaatgtacatgaatgtaatatatatgacaactataacatagaagccactaggggatagtaaaatgatgtatgggactataagtattttacatcttacttgaaatattaagttattaactcaagaaagtgtgataatttaggcacatatattgcaatccctaggaaaaaatacaaaaatataaaaaggttacagataggaagcccacaaattaaacagtatactaaatacttacaaaaaaaggagaaaatgagaagtagaggcacaaagtaagaatatgcactatatagaatatactatttgaagtactagcccataagttctagcccataaaattaagtccgtgatgtgagaaaattttggcttaagagaaaatggagtaagccacagagtagaagattcagtgcagatgagtgaacccttaaaatgatgtagaagagagaagctgaattgggtagacagtaaattacaatgaacaaatagaatactgcctttgtttactatcattcaaagtattatatgttacatagtattacttgaaaatgctatgaaccatggaagtggatttttccaaatcatagaattcactaatctaacaattatggcatttataaatactattgataatattagtaaacatttttaatacagtttttatcatataaacattttggtacatgttatttcttttaagtgccaatagtttttgtattttaactgcatatggcaaagtattttcctaaaatattagaacatttatcaatggtgcatactttacctcttcgtaaagttaagttaatgctctaatttttaaaaatgttcccattagggcaccaattgtaggatggagtggaataaaatgataatctcagaaacttttgcctctatactttgtctccttcctatgtgtctgcctccagcgactgtaggccatttgaagattactattgctgctattctggttacctagaaaatgagacagattataaggcctatgaaaagacttaactttgtttatgtagaattttcattaaatttgctaaagggaagtgcctaaggaggtttcctgtctttagcaaatatatttattggtgaccagatccttttttgccttaccttcacagttatttctctaacatctgaggttttggtagtctgatttttagctaagtatgatatttaattcaattaaaagtctatattcattaaagaaggcttacattaagaagaatgaagttctaatttattttcatccatctatatatattattgttgtgttatataactaaaatcttactattatagattttttttcttctagcttaaaagttccaagtgttctatcttagtaatatgatttattctggaggagagggatgttgtaacaaatactttccagtacaaactaagatatttgcattttcaagttttgtattagaagcagttttgagtcttagtagtcttataaaattatgattaagtgaccaacaagtataaattttgagtcacagatatttaattacagtcgagttaaaagaagaaagaaaatgaaataattggaaaaagatctttcacaggaagaatgtcttattgttagtacggaagagaaataaaatgagaaagagaggaagggaggaagaagctagatatttatttatttacgtatttatttatttagagatggagtctcgctctgttacccaggatggagtgcaatggtgcaatctcagctcactgcatcctccgcctcccaggttgaagcaattctcctgcctcagcttcccaaatacctgggattacaagcatacgcctccacgtccggctaattttttgtgtttttagaagaggcagggtttcatcatgttggccaggctagtcacgaactcctgacctcaagtgatctgcctgcctcagcctcccaaagtgctgggcttacaggcatgagccactgcaccgggcctgatttcttttttgtgtgtgtgaaagtaggaatggagagcaatcaccaagaaatccgaaatgacatccagacagcaagtaatgccaactctgacaaaccactgctgtgatcagagtttgcacctctttaagatttcagatgttgattctttcttcatgcatattcccattagaacatttatcactgatacatatttcctaatagctaaaagtttactcattaccagagattgatggagaaaacaatgttacaattaagaaaagatcttggacctgtcataagaaaagagacaccatttggaataagaagaccaagaatatgccatttactgccttcaagagccttgagaaactgcataaagcagtcttaggaggatgaattcaaataatggcaatattgcataataatgttatttttaaaagattaaaagaaattctgcctactgcatcatttattattaaactgtatattaagactttctaaatttgcttccctaagatagagtgatattcaatcatttttgctttaatgaataaagtccatctttaataagtaattgcaagtgggagagaatcgggcctttttaggtcaaatatacttgagacatgagggttcacaaaatctgactatggagaatttgcatgatagggttcactgtgcaacagaaagcagaagtttctatcaatggataaaatgaaaagcaagattgtgtcacagattttttgtttctttgctgctatataatgccatactcccctctgaccctcttccaaagtatccccagggtagactatactaacgagatcctttttcagcaaaagaaagtcaggcactattcacaatagcaaagacttggaaccaacacaaatgtccaaaaatgatagactggattaagaaaatgtggcacatatacaccatggaatactatgcagccataaaaaatgatgagttcatgtcctttgtagggacatggatgaagctggaaactatcattctcagcaaattatcgcaaggacaaaaaaccaaacaccgcattttctcactcataggtgagaattgaacaatgagaacacatggacacaggaaggggaacatcacacaccgggcctgctgtggggtggggggaggggggagggatagcattaggagatataactaatgctaaatgatgagttaatgggtgcagcacaccagcatggcacatgtatacatatgtaacaaacctgcacattgtgcacatgtatcctaaaacttagagtataataataataataaaagaaaggaacagaaatgtttaaacctcccccttgactagaagtaattaagtaactaaattacaaatacacacacttacatctggggaggttaaactgattttatgaattgtataaatgacaaggattcatactctggcttttcaggttttcttttttttttataagaaagcccatcatttaacagtaaatagaggttttctagtgtgtcaaatggggatatggtcagattaatggcgaattcaatgctatgcatgtttttaccctatctctttttatttttgcaagatgtggacaccttttaaatgcattagtttcttcctgcattgtacaaagcaaataaataggttctttaaattccaaccagtcaataattgaaatatatgcacaaaaagtatatgtataaaaacacatgtaaactgatcaagtgtcctaaaaacacatttaaaataaaaatacaaagttagaagtttagcacttaactgaatatatgttaatatgcattataaaaatagtaaactcatataacagagatagtatagcttgaaaattaaggactaaagtcagaatgctctttttcagctccccaatactcctatttatttgcaatgtaacttttgataaacttctcaaactctttaaaacttaggttcctcaactgcaaaatggaaggaaactaatcactaactcaaacatttgttttagtgattaaataaaatatagtaaaaagtttttagtagaatactcaggatataaaattctataaataattaccaaatagaatttggttgcgaaatggtcacaaagataattgcagagaatactggaaaaataattgacaaaaatttatatattatttaaaagattgaagtttacaatgcatgcagaaaaatgcataaagtcattataaaattgaggtgttaatgtgatttttactacacaagttggaataactgcataatttcaaatataataaattgttagtcatcaatttgaaaagattttatgaaaaaagccatgattttatgacacagaatctatatgttgtatagaaagcatgaattatatttcattttagttatggtctctcttttcttgatataattaacatttaaaatatgttttcaagggtatattgttcaatgtcactataaataatttatgttaatagaaaagcagaaattaaaaatgtgatagccaatattttgggtacagcaactttcatgacaatcatttcttttgaatatatctgctataaatacaaattgatacaaagtaagcatgataaactgtcatgaattttaaactatttaattatcatcattataattgccatgaattattgtacactcaccatttaccgagaatttctgtgttattttttactttgtgtgttttttattgtgtatatttaaggtgtacaacatgatgttttgatatgcaagtagataatgaaatgattactataggtaaacacattcacacatccatcaccttccatagtaatgtctcattgtacatgtgtgcacgtgtgtctgtgtgttaacagtacctaaaatctacattttatcaaattttcagtataaaatacaatatgatgcaatattctttatacattacgtaaaaatgtagaccaagggtagattcacaaattatgcatctgacaaaggtttaatatctagaatctataaggagcttaaacaattgaacaagcaaaatacaaataaccccattaaaaatgggcacttctcaaaagacacttctgaaaagaagacatacaagtggccaagaaacatatgaaacaatgctccacatcactaatcatcagagaaatgcaaatcaaaaccacaatgaaataccatcccattttctgttactattagaaaataaaaaataacagatgctggtgaggctttggataaaagggaaagcttatatactgttgttgggaatataaattagttcagtccctgtggaaggcagtttggagatttctcaaagaacttaaaacagaactaccatttcacccagccatcccactcctgggtttatatacccaaaggaaaaaaaaaatttatcaaaaagacacatgtatttgtatgttaattgcagagctattcacaataataaagacatggaatcaaccaaggtgcccatcaatggtggattggataaagaaaatatggtacatatataccatggaataatacacagccataaaaaggaaaaaaattatgtcatttgcagcaacatggatggaactggaggacactgtcctaagcaaattaatgcaggaacaagaaagaaatatagcatgttctcacatgtaagtgggagttaagccttggggactgatgaatataaagatgttagcagtatagactgggggatactacacagggaaatgatgaagcggggcatggactgaaaaactacctattgggtactatgctgaccatctgggtgatggaaccatccatatcacaaacctcagcatcatgcaatatactcatgcagcaaccctgaaaatttaacccctgaatccaaaatgaaaaataaatatatatatatttgtacttattataagtgaaaatatacttaatattttcagatcatttattggttgtatttataagtaaaattgacttttgtacattgaaaaaaaagaaaatgtggtctatatacaacatggtatactatgcagccattaaaaaaaccttgttatttgcagtgacatgaatgaaattagaggccattatcataagataattaaagcacaaatagaaaaccaaataccacatattctcacttataagtgggagctaaatattgagttctcatgggcataaagaggaccatagtagaaactggggactactagaggaggaagagagaaagggggaacaagtgttgaaaagctacctactgggtgataagatcattggtacccaagcctcagcatcatgcaatacacccaggtaacaaacgtgcacatgtacccgctgaagctgaaataaaagttgaaagaaaaacgcagataaaaaaatgtcctttttctctttatatatatatatttttattatactttgagttctagggtacatgtgcacaacgtgcaggtttgttacatatgtatacatgtgccatgtcggtgtgctgcacccattaactcgtcatttacattaggtatatctcctaatgctatccttcccctctccccacaccccacaacaggccccggtgtgtgatgttccccttcctgcgtccaagtgttatcattgttcaattcccacctatgagtcagaacatgcggtgtttggttttttgtccttgcaatagtttgctgaggatgatggtttccagcttcatccatgtcccttaaagcagattaatgtataaaacagtcttcgaactaacttggacttacaaatttgcacattttcttttaagagcatttcatattttctactttacttccgaattttcaagctgagaaattttgtttataattttattttctgtggattttataaggcactacaagatcactgtagattaaaaattaaatagtaaacagtccctaacttcaagttgttcataatttatcacaggcactgaggtggatgcctaaatggcatactcatatacaggagagaggtcagaggccagtctagcaactgaattttgtggatttgtcagtaagaattagaaaagtagttgtgatgttcatgacaatagggtgaaagaaagatgtaaaagatgtcatgtgaagactgaaaagtattttcctttttgagttagacacaatagtatgtagtctttttcagtctgttttaaagcccttaggcatgaacagtaatgtattcaggatctgtggaacaggtaacatagtgaactgccagagcgaggagaaccaagaagtggaaaagagcagtgaactaagtaaatccttagatctatgtcatctcaaattggcaaatttgctgatattgtgattgacttaagtatcaataatatcaacaaaaatattggtagttcatctaaattttaaaattcaggtttttctgttgttttctttaaatatctaagtcagttccccacttactgcccatggcaattcaaattccctgattaacactggagctttttgcaagatttgaaaatctttctcaagatcatagtttattcaacctttgttttgaatttttcaagtaattcaaacctcacaaccatattatgctattattaataaccattttaaagaaactgaggaagggatattgaaatagcttctcagatctatccaactattaatattaagtaatgtgaaaaagaataaaacccagaatgtctaaattatttaatatctatttttaaaataaagtcctgagttattccagaataaattatttaacctagtcctaagattaaaatttttgttttgaaatctcacatatttgaaggacacgtgacttttttacaccacattgtctgaattaattagcaaaggtattgcaagcaaaccaacagcataatagtgaacacttcctcatatcttaaaaaatcaaattctatagactttctaaactatgaaaaatttacatttgtcattcaacaaacttattctgtgtcagtacctgtttcatccatttagatgcaacagtgtatgaaaacagacaaagatttctgttcttaaaagtttacaaagaggagagcctgccaatataaaaatgaatatataaattttgaagtatgcaagaaattaatcaatactataaagaaatagtagagcaaggaaagcatttttaatactatctagaattttcaaatcttcttatggtttaaagtatagtcatgatactctcttgggtaaagtgagtagggctggtaggtgcctgcatgtatgcatgtgtgtgtgtgaataactgtgtattgctatttagaagagttagggtggtcaaactctaaaaagattcacattgaaatagtcatcttctaaaaggtcacatgatatgttaccttagctattttttttatacttgaaataccttgggcagtaacaactcttcccaaatttgatttaaatgataaaaagaaagatcagtgaatgactatagttataaaaaatgtctataacaactgtcagcaatctccagcaatttatggtactctttgtaagcgaaatgactttattatagagcaagagtggagccttttcactttcaaagttacctacatctagctgcaattgttggtaggattaagcctcatcaaaaataaaattgggagtaaggaaaaatcctagaaatcaaagttgcaaaaaagactagaatagaaaactgatcacactttggaagttactctgactaaacactgaaaaacaaaatgcctttttaatacttattattatcattaactttggaaagagaaaggatcctaagttaatttaaccgttagtcaattttacatgaatacataataccctaaataaatatcttgttcattaggtaagcatatagttttatgataaaatttaaaatctatgcttctattatgattcaaatttacacaaatttatttggaagacacagtcatattatttttattttctataaaagttttggaaaaaaatacactaaagaaatactgcattgtaaaaaccactcttgccattagagaacatgtaagtgttctttcatgtataagtaataaagaatcaacatttgctgcttttggaaacaaaatgaaacaagagaggaaatatgtctagcttttagggcaatttggtaatatttgagaaacacagcctgacaactcaaagggtattttttaatgtttatgtaaatgtatacatatgcatacatgtgtacatataagtatatatatccaacatataaacatgtatgtatgtatacatatatagatatgtacacatatacatatgtatgtatacatatatagatatgtacacatatacgtatgtatacatatatagatatgtacacaaatacatatgtatgtatacatatatagatatgtacacatatacatatgtatgtatacatatatagatatgtacacatatacatatgtatgtataagtagttaatgatgtataaacatatgtacgtatgtgtgtatatatgtatatacaaatttgatagttacatgctacttatagtttttataaaaacacatattgctgtaactctttatttctccaactttgctgcaattaacacaaaataggtgctaaatgatttttattcctgttgatgctctcttcccttctctacaataaaacaaccttttgtattgtttttgtttctttttttttcttcttgctgaatttgaatataggttctcttcttccttaatcacatcaggacattttccacactctgaaatacccagtcactttgaagtaaaactacccatatattattgtgaaaatgttagaatgtgagaaatacaatctttcaacgtaaaacaaaacattccaaaataaaacatgcctataatcccagcagtgatcataacaaacatcaaagagacaatgagggatatctaaatgtcttaataaaagttaaacctaataagcatctattggtttataatgctataaattctaatgttttgtataggaaacatgtatatttcattttctttttaaaattttcttggtaaaaaatgtacagctttcttttatagctcagtctagagggttataaagaagcctgaaataattgtcttctagacttaacaccaaggacaaatggaattggcaaagatttttttaaagttacaaaacttagtgtgagggaaatgattgctctcatatgcttttgttagcagtgtgcattgacacaaccttctggagtttagtctaacaacacagattaagagacataaatgtgtgtattaccctctgatgtagcatttccatttccagaatttatattttttaaaatgtcaaagagatacacaatatttagaggcaagaatcttcatagcagtattatttgcatacacatacatatacataaagaattagaagcatctacatgtccagcaatatggatatgattatcattatacacacacatgcagacacgcacacacacataatagaattctagttaactatccaaaatgatttgaaagaaaataaatcatattgaaaaatatttaaagtttcttttcaactaaaatggtaacaacatggtacgtataaataatatatttttatttatttttcactttttttaaagagatggggtcttgctatgtttcacaggctggtcttgaatttctggcctcaagcaattctcccatctcagcaattccaaactgctggaattataggcatgagccaccacctgtatttaacaatatgttctaaatacaataatgtatttttaaaaacatatatattatttattagggcagcatatattaaaatatccctgatagtgacaatttctaggttgtaaaacagtcctcttttttcttatttgtattttctaaacatgtcactacacacacacacacacacacacacacacacacacaagcaagtcttctttttcaaagaacagaataaattgatataagttgtattttcataccaaagtattcttagaccattttcaaatttgataagggtatttccacttctacaaacaaacattagaacaacactacactatttttacacaatttttaatcagctaaattaaaaaactgtgtaaatatgcttgagcaacaaaatttatagatatcacattttagtaaagttactcttgagaatccaaatactgctatcaattctgtcttcaattctcagcagattgacatagttataatgttttctataattatcaacttgaaaaagttgacacatttttatttttaattatatatatactcgggataaggataatctctttaaaaaatgaaaaattcaaaggattgaagtttacatgagtatgatcttagtaatttacattttctaccttctaaatgtatatgttgttgaacagaattccaaccttatttattctcgagaaagtattacaaatatactgttttcaaatatcttttagaatttttagaagtgttttcgtatttaaaagttttcagcttgttagaacaaattttctctaacgtataaagtctattttcctgggtgaagttgcaaagattgtcagagattaattaagatgtccaatgaaattatagtcatatatgatacaacgcataattttctttaggtcacagaatttacaatttcatatttatttagcagagcaaatgtaaattttgtaatttgttttatttgaccagttctacttgtttataaatttcaaaggagaataactgggtttaatgctaatatttctttcttgtatttatttacaaatgtatcgtgattcttacataaaagttcaaggcattagtttgtcttagttacttctggctgctataacaaaatatcatagactgggtgattgtaaactacagaaatttatttctcacagttttgacgtctgagaagttcaatatcgaggatggttagatccttcttcttgttgtgtcctcacatggcagaaggggtgaaggagctatctgggtttcttttatgaaaacaccagtcctgttcatgagggtagtaccctcataaactagctaccacccaaaaagtcccagttccagatatcatcacattgtacattaggtgtcaacaaatgaattttagggagacataaacattcagtctacagcactgttttctatgagtgagcaggaacaaaaacaagagatataattcctctttatagaggctattatttaataaataacattttaccccccaaaattcttagtttgaagtattttataaacatataattagatgagtgtgtattgtttctattctaaatagaaaagtccacatttcttgaaggaaaatcaaaaggttttgtggagtgcaaattattggaagtacagtttacttagaaaagtatgttaggtgcataaaatgaaagttttgagtgtaaaggcagtgacaatatatttatattttagacaaaaggggctcatttgcattatggagagtgattctattattttctgaatcagttcactccaacatattcatatggcacttatttatttgcagaactttagacttcagtagagcctgtaagtctcctacttggcttcatttctgcctcactcatccatgcctttccagccattctccctggtgtcattagagtgatcttgatgttaagacaagatggcctactagatgcagccaggaagtgccacttgcacagagagagaccaaaatatcaagtacaccaacatattttaaacaaatatttagagagaaaacaacaagagttattaaagacgcaaggtaaacactgtggctaaagagcaaaaaagcatgaaatcttgtgcagggttgctgaatgccagggctaatttccagtccagatcagcttctagagaaggtgtgagtaaagggatggtgaggtggaccactctcacagcagatctctgggatcccagctacaagagatgccatgacaccaaagacatttgaactgacaggagaatcagcccagagagtagacagagacagagacccatgctgcagagccgaggagcttctgtgttctgaggtagctgcagtggaacaccaccataggcacccttctctagaggctttctgtctttctctgaaaagctttaactaaccccagctggccaccaggccaagagagagcagaaccaactttcctgcaggactgggtacatctgttctgcatgttcccctgcctgctagcctggcttaaggcccctccctggctactctcacagacgtatgtgcacagtacagcctctgctgcccaacctggtgctttgcctgcagtcccacctgagtactttcccagtaggctgagagtagttaggatcccccaacacagccagtgtctgatctcgaggggcaaaaggatgtagctgagtgttgatcccaatccctcagggctgcagcatgcagcatgggaggatcccccacactcagaacactgagaggggtgagaaatgtgggtttgtggaccggcgtgggagtgggctgtggctccaatcacagggctggtccaggaagagtgagacctgtcagtcagcccgacagcctttcctgagagagcccaaatgcccagaacacctgccaaaggaaatgtggacatggcaccagtgatcagaggaggctcccccaaggcccaagagcaggcttggtgagtggggtcaggtctttccccagcccaccaaaaagcaccactgtgaattcaatgaaatacaatatagccacacagctgatttagaggctatcttctggccattactcttaagcaccatctactagattacagttcaaattacaacatcaaaaatattctgccagtatgtactacctgtgacacccagggcaagaatccagccacaaataaaaatcctgtataaaggcttttccttctaaaggactcagaaacaaagcttacagactatactaaactcaaagaacaatagcttctgatgagaaagaatcggcataagaatgatcccaattcaaaaagtcagagtgtcctcttacttccaaatgagtatgctagttctccagcaatgtttcttaaccagactgaaatgacagacagataattcagaatctggatgacaaataagcttatcaaggttcaggaacaagttgaaacccaatccaagaaatccaaggaatcccataaaatgatctaagagctgaggaaaaaagagccattctaagaaagaagcaaaccagacttctggaattgaaaaaatcactacaagaatttcataatatagcctgtagcataaatagcagaatagaccaaaaattaggaatgtcagaaattgaacattagttcttcaagtcaactcactcagaaattaataataaagaaaagaaatttaatgaacaaaatcttcaagaaatatgggactatgtaaagaaatacaacattttactccctggcattcttgagaaaggagagggtaagcaacttggaaaatatattggaggatacaatccatgaaaatgcccccaatctttctagagaagttgacacgcaaatttgagaaatacagagaacccctgtgaggtactatataagacaacaacctccaagacacataatcatcatattcaccaagatcagtgaaggaaaataaatcttaacagcagctagagagaagggttgggttacttacaaagagaatcacatcaggatagcagtgaaaatctcagcagaaactttacaagccagaagacatcggggcctatttttagcatctctaaagagaagaaattccaaccataaattttatatcccaccaaactaagcctcataaaggaaagagaaataacatccttctcagacaagcaaacattaagggaatccattatcgctagacaagccttataaaaggtccttaaacatggaagcaaaagaacaatacccagtaccacaaaaacacaaataagcacatagctcttctattaagtaattatgtaatcaagtctacaaaacaactgccaaacaacatgatgacaggattgaaatctcacatatcaatactaccctggaacgtaaatggtctaattgccccacttaaagaggatagagtagaaaggtctatgaaaagacaagacccgactgtctgctcttttcaagagcaccatgtcacatctaatgacatgtacaggttcaacataaaagaacagagaaagatctatcatgcacacacacacacacacacacacacacacacacacacacacacaaaagagcatgagttactattcttacaagagagaaaacagacttgagaccaccaacaatcaagaaggaaaaaaaagggataaaggttcaatttaataagaagacttaactatcctaaatatatatgcacccagcattggtgtacccagattcataaaatcagttcttcttgacctatgaaaagttttagacacccacacaataatcgtgggacactttaataattcactgatggcattagaaagattattgaggcaaacaactaacaaaaaaattctggacttaagctgaacactcacaaaagtggacctaacagacatctagagaatactccacacaacaatcacagtttatatattcttctcatgtgcccacaaaacattcttattttttaagtttaaaagacagagtgttttaacgtcagtctgttgatagttaaacccagtgagtaaacattgggagtctttgcctagagatctggattctgcaaattaatcaatcgtcaaattttcaggctcagcaaagcagttttatctgagtgcttaaaatggatataccaatcaggggaaagactgatatcaattgaatgcttgcaagagactggtgtataaactgaagttccaatcgttttaatttataacaataactgtgacagaagaatcagaataattatgctatcatggtcacgtctttctctctctgtaaaacaagcaaatgatgatttcttgaatagcaatggagtcatttggtaccagtgtttaaagggatcattctctgtgaaagagatctattaatacaagagccagaacattcctactcctaactagtgtacatttagatactgatatataatgccttagagctagttttccaactttccactttgatacatgtattctttccttgaatgtatccagttaggactaagccctggaaattgttttgctccaaaaggtgactttgcagatcagacttaattatctgcattgcttgaactcctggaaggtggtctttatttcttattcgtaagttttggagtggctattgactttagttgtcataaacttaccaatttagaaaacaagtatttccgaattttgatgtttataattgtgctcttttaggggttcttgattttcttagagctgaagaagttagtatgtgtttgacaaatgtctgaagattttctatttctaactaccaatggttaagtttaaatatatttacataatatgtcattttaaggtaatttgacttttatgccatttgaaatttcaaatacaatcacaaataaagcaatgaagaaaattaagcttccaattttattctaaatactattctttcctgaaagtttcccaggagacttactttagttgttaaatttctgtaattttactagcttgacataaatgttaaaagtttgtttttacataaataaacattgcgtctaaaataaaccttactttcttaacatcataagtttatatcaaaataaaaacaaataaattttgaatgtggaatgttatttgtaagctaatgaaatcatttaggaataaaaccaggattgaaactataagagcgttttaattcataactcacaagatatagattaagaaaggtagcattagctgcctgaaatcagtggtaacataagagtaataaaaacacagtatgcaaaatattggctgggcatagtggctcatgcttgttatctcaacacctttgggaggctgaagtgagaggatagtgtggacctacaacatagtgaattctcagtatgttgcccaggagtttgagatcagcctgggcaacacagtggaaccttgttttctacaaaaaaaaaaaaaaaatagaaaaattagctgggcatggtggcacatgcctatagttccagctactccaggaggctgaggcaagagtatcgcttcagccagggagattgaggctgcagtgagtggtgaccatggcatcgtactccagcctgggtgacagggtgagaccctgtctcaaaaaaaaaaaacaaaaaacccaaaatgaaacaaaacatcattcactaatttatctaaggcagatacctacaatgtcctagattttgttttctctcttgaactatccagtgagtaagcaaattagatttattctgtcctttatatatttcacttccaataaatggcttgaagagtttcagtggtcttcagttctctgatttttctcccaataagaacctcaattctaaaatctatgaggaaccgtattatttctcagttggagattattcttcacaacattgcacccaagaactttcaagcataacagtccttcttaacattaagatatatcagagcacattatatcatatgattgaagttctattagctgctataaatggtagaataaaattaataatactttaaaataaatttctatttcaacagcaaaaaaaatgtggttattttaaaaagagtggtaacaataggagacagagaaattctgggcagacagaggtgggtccctggcaaaaccccaccttcaagccaaaaaacttgaaatctgtggcccaaagtgggagcttctatccctgtgtgcccactctaacccagctggtgctctctgaataacatctttttgccagtcgaatgttgccttttccaaaactacctacagcctgccctgtgcctatcttgtgcctataaagaccccagactcagccagcagaggacagaagcagctggatatcagggagaagcgacttaacttcagagacagtggctggttgaggcaacttaacttcagaagagagaggtagagaggtggcttgacttcaggcaagagcaacttacacttcgtgtcccctttccagctcccctccccactgagagctgctttcatcacccagtaaaattctctacattcatcacctttcagttcatctgtgtgacctctggacatgcgacctctgagagacctctgggcactgcacaagaatttgggacacaccaagtgtgggtaccctaaaaggctgtcacactagccctttcctcttgctgccagagggcagctgccccaaactacaaggcaaagggcctattgagctgataacacactgctatctgtggacagcagacctaaaagagcattgtaacatgccctctggggcattgggatcacaggcaccctgacctggatgctactgtgggacatgcatgaagtttaactcctgctggcactgaagctgctggccagttgccacacttgtttgctcatacactccctcctccgaggggttgaaccatgtgggctgagtaaatgaggcacccttgtcaggagtcctgcaaaggagttaagaaattatcctgcatcaaagcctcaggagccgatgcgatcaactggaagaaagggtatcagtgatggaagatgaaatgaatgaaatgaagcgagaagggaagtttagagaaaaaagaataaaaagaaatgaacaaagcatccaagaaatatgggactatgtgaaaagaccaaatctacgtctaattggtgtacctgaaagtgacggggagaatggaaccaagttggaaaacactctgcaggatatcatccaggagaacttccccaatctagcaaggcaggccaacactcagattcaggaaatatagagaacgccacaaagatactcctcgagaagagcaactccaaaacacataattgtcagattcaccaaagttgaaatgaaggaaaaaatgttaagggcagccagagagaaaggtcgggttacccacaaagggaagcccgtcagactaacagcggatctctcggcagaaaccctacaagccagaagagagtgggggccaatattcaacattcttaaagaaaagaattttcaacccagaatttcatatccaggcaaactaagcttcataagtgaaggagaaataaaatactttatagacaagcaaatgctgagagattttgccaccaccaggactgccctaaaagagctcctgaaggaagcactaaatgtggaaaggaacaaccggtaccagccactgcaaaatcatgccaaattgtaaagaccatcgagactaggaagaaactgcatcaattaatgagcaaaataaccagctaacatcataatgacaggatcaaattcacacataacaatattaactttaaatgtaaatggactaaatgctccaattaaaagacacagactggcaaattggataaagagtcaaaacccatcagtgtgctgtattcaggaaagcagagacacacataggctcaaaataaaaggatggaggaagatctaccaagaaaatggaaaacaaaaaaaaggcagggtttgcaatcctagtctctgataaaacagactttaaaccaacaaagatcaaaagagacaaagaaggccattacataatggtaaaggaatcaattcaacaagaagagctaactatcctaaatatatatgcactcaatacaggagcacccagattcataaagcaagtcctgagtgacctacaaagagacttagactcccacacaataataatgggagaccttaacaccccactgtcaacattagacagatcaacgagacagaaagttaacaaggatacccaggaattgaactcagctctgcaccaagcggacctcataggcatctacagaactctctaaaccaggaagaagttgaatctctgaatagaccaataacaggctctgaaattgtggcaataatcaatagcttaccaaccaaaaagagtccaggaccagatggattcacagccgaatgctaccagaggtaaaaggaggaaatggtaccattccttctgaaactattccaatcaatagaaaaagagggaatcatccctaactcattttatgaggccagcatcatcttgatactaaagctgggcagagacacaaccaaaaaaaagaattttagaccaatatccttgatgaacattgatgcaaaaatccttaataaaatactggcaaactgaatccagcagcacatcaaaaagcttatccaccaagatcaagtgggcttcatccctgggatgcaaggctggttcaatatacgcaaatcaataaacgtaatccagcatataaacagaaccaaagacaaaaaccacatgattatctcaatagatgcagaacaggcctttgacaaaattcaacaacgcttcatgctaaaaactctcaataaattaggtattgatgggatgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaatcaggaaaagaggaagtcaaattgtccctgtttgcagacgacatgactgtatatctagaaaaccccactgtctcagcccaaaatctccttaagctgataagcaacttcagcaaagtctcaggatacaaaatcaatgtacaaaaatcacaagcattcttatacaccaataacagacaaacagagagccaaatcacgagtgaactcccattcacaattgcttcaaagagaataaaatacctaggaatccaacttgcaagggatgtgaaggacctcttcaaggagaactacaaaccactgctcaatgaaataaaagactatacaaacaaatggaagaacattccatgctcctgggtaggaagaatcaatattgtgaaaatggccatattgcccaaggtaagttatagattcaatgtcatccccatcaagctaccaatgactttcttcacagaattggaaaaaactacttttaagttcatatggaaccaaaaacgagcccgcattgccaagtcaatcctaagccaaaagaacaaagctggaggcatcacactacctgacttcaaactatactacaatgtacagtaaccaaaacagcatggtactggtaccaaaacagagatacagatcaatggaacagaacagagccctcagaaataacaccgcgtatctacagctatctgatctttgacaaacctgagaaaaacaagcaatggggaaaggattccctatttaataaaatggtgctgggaaaactggctagccatatgtagaaagctgaaactggatctcttccttacatcttatacaaaaattaattcaagatggattaaagacttaaacgttagacctaaaaccataaaaaccctagaagaaaacctaggcattaccattcaggacataggcatgggcaaggacttcatgtttaaaacaccaaaagcaatggcaacaaaaccgaaaattgataaatgggatctaattaaattaaggagcttctgcacagcaaaagaaactaccatcagagtgaacaggcaacctacagaatgggagaaaattttgcaacctactcatctgacaaagggctaatatccagaacctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatgagagaaatgcaaatcaaaaccacaatgagataccatctcacacaagttagaatggcgatcattaaaaagtcaggaaacaacaggtgctgtagaggatgtggagaaataggaacacttttacactgttggtgggactgtaaactagtttaaccattgtggaagtcagtgtggcgattcctcagggatctagaactagaaataccatttgacccagctatcccattactgggtatatacccaaaggactataaatcatgctgctataaagacacatgaacacgtatgtttattgcggcactattcacaatagcaaagacttggaaccaacccaaatgtccaacaatgatagactggattaagaaaatgtggcacatatacaccatggaataccatgcagccataaaaaatgatgagttcatgccctttgttggcacatggatgaaactggaaatcatcattctcagtaaactatcgcaaggacaaaaaaccaaacactgcattttctcactcataggtgggaattgaacaatgagaacacatggacacaggaaggggaacatcacactctggggactgtcgtggggtggggggacgggggagggatagcattaggagatatacctaatgctatatgacgagttaatggatgcagcacaccagcatggcacatgtatacatatgtaactaatttgcacattgtgcacatgtaccctaaaacttgaagtataataataataaaataaaataaaataaaataaattatcctgcatcaatggcagcacctgtgcttatagaaaaccgtatgtttagggtacagatgtttgtgcatatgctgagaatgtgtattcttgcaacatctctgaaaatgttgcgatttttttctctctctttttttaagtactactttattgagttacatgggacatacaataaaatatcctattataactatacaattgaaacattttggtaattttgtatagccatgtaatcaccataacaatcaagatgtaaaacctttcattcaccttaaaaagttcatttgtgcccctttatggtcattcacatccccttttctgagtatagttttacaatatattctttcagaaagcttgcaattttccattcttgaatatgtctttgaaagatcaaaagttgtaattttgatgaagtgaagtttatccaactttttatttattgttactgtttatatcacattattaaaaaaaaccttgcctagccctctaaaattgttcaaattttatttgataaaagtatttgataaaattcaaatacttagtatagaaaaaataaacttttagattttgtttcaattttattttttagccccatgtctttctctctctgacatatagacaactcctatttttatcaaactaaacatattatacaaacaataaatcaaaataataaaatagtgataattttaaaacttagactattaaagaaatatattttatttagttatgtgatttcatgatagaaagcattgtataaatgatgcaagaaaccccacaaaccatagcaatcatttaaaaaaaaaacgtgctttaaaatcttctacaggaagaaattaaaaacaaatgtagagatagggaaaaatattttaacataaaattttagtttcagaaaatacaaagcattctgacatttgacttacaaaaagacaactcaaatagagaaatagaggaaataataaaaataggcaactagttcatcaaagaaaaagggattgaattataagtaaaacataaagtgttcttagctttctgataactagggaaatttaaacagaaatagtaataagatatgtttgaataaccatcagatgataatcgacaatgagaaagaatgaagttgggaatataatgtatttctaataaaaccgaaaataaacacatctaaaaatctagtgattctacttctaagaatatgcagaatatgcacatcttatgatctagcaattccacttctaagaatatacactaaagttactcttaaccactgctcactctaaacattagaaatacccaaatatctttataaactatttatttgcatatcaataggtatagaacgcagaaatattctcttgagaggataaataggcagcagaccacacacaacatttaaacagtatatagtaaaattatggaaattacttttgaaggcccccgtcatctgcatacgaatgcttattcgaggaaaaggaggaaagaaataggacctaaaggaagaacaaagagagtttgacattgtctgtaatatttgcttttatataaatataggaattatacctatcagaaattgtatgtaataaacaaccacaacagctcagtggcaaatgaaaataataatttattttccacatctatagtgcataggatggccctgccattcacatctgcattatgcctgtatttgaagactggctggtgttctgtgtgtccaggctgggctcagctaggcaccaccacttcaagctgcagatctgcttgattcaattgtactgtaagtgtttttaatctggatcccagatggaaagagtagcagatacctacaggaagttcttgtggggatggtgaaaccggcctaattatcccatagaactgatgcttacagttgtttgaataaagagaaattgaccctccatgtcttaaaacttgaaacttacttttgtattatgagttccttcctcagtaactcataatagtttcttcctcaaacaagaaactaaaactcaccagatgactacatccagacaataagacgccagacccctcacccatcatgattttctaacccctccctaattactttttaccaattcctcttcctaacccttccctaattcctgttttcctacatgtagctacattcctgccccgctatataaacctctgagtgtagttggttggggatagggagatggatttgagacttaactcctacctccttcactacagcacccaaacagtgacttctgccctagcaatacttactgtctcggtgattgtctttctatgctgtcagcagcaggacctagataattgttccctcctctagtggatgcatttgatgatgggacctatagagtgataaagacaaaaacccaggacagagcctgggttttgagtggctctcttgcggacaaccacatgagcaataaaagaattttgattggtttcctcctcagatatttaagcctatttgttatgctatttactctaactaatagttgtaccctagtacttatcttgcagaagccatttccaatgtgaatgagcgtaataattattagaatgatttcagacatgttagctcaaagaaaaaaataagctctcacaggaaaatactgagattcactttctcaatctttttagagaaggtacattatacagagtcatgaatgtcaatacctaaaattatgtggtaataaatttaataatgtttcagaaatgcttaaaatatctgtaaaaatgagataaatgtgtttgattgttctttcaaaatgtgttgttttcaagaaagagaagctatatatttgaaaaattgttaacaaatctgattgcatggaagatcatacaataaatatttatatatacataatgttctattaaaaggtaaacactgactatgaaaaacacttctataattggctcagtgtaattgagctcaccattcagccttttataaaacgttcatcactaaatgcttttaaataatgtatgagtcatgtaattgctctgagtatttttataatgactgtagttcatactagaaaatgtacctactacctatatgggtctcccataaaaccatattgaaccctaatagatatgaatttgaaagcagatatcagtagatttattctaagaaggaaaatataattaaactttatcacctctatttacagtttcaaattaaaggtaaaaagacattaaaaatttaaacacataatacatagctttttcaactttagatattacaaaaatgcaaatattttcaataaaatccagatggctacaattgctaagaacttagttaattaaaattatttttaattcaaaatgtgtacttccttgtaattgattttaaattacttaattcctttctgcatgatttatgtcattaacaaaaccaagttgccactaagaaaataatccaaagaattaaccagtgataaattaggctctttggagtatatacctgtgagccatgtcatttcaaagttaaagcagcgtttttgatgctttgacaaggagaagaaattgaatatagaaattgcctttatcaatattttacagcatagtacttgaataataatgttaaaaacaaggaaattgttacttttattgtgctcattgataaattgatttagtgctaatgtgttcagacctaatcaaattcctctttaccagaaatggattttgacccccttttcccaaccatattgaatgccttcatttctagacagtaaagctagaagctataaaatatatgacagtgtcagggcactctcagagtatgctggacccattctcataataccagataactttatggcgtttccaggatgcataggactcaggttacatttccaacatgaaagtacatgttcctttaacaaattaccttttcatgaagtttgactgtattgtgccccattatttccaattagcatggtgatgcttattttgcttatttttcaccttcaattgctatagctctatgcaaattctttttctcaaaaaactggccttttcacctttaccagattgctaattttctcatgaaattcctaaatatatatatatatatatatatacgcacacacacatataatattatatataatatataaaatatatattataaatatatattatatatataatctttatatattatattatataatcttttttggtttttgaataatctttattctaacctgtgcttatgaacattttatgtgccattactgtagtagatttttgtttgtattttggtcgtaagcacatattcctctttctgagtgcaatatcaccaatactttctttggggcatttgtttttccctacttttctcatttgtatattctatttgagacttattttaaaaagtccctgattatggcaattgtctcaagtatatgcagccaacctaatcagatatatacagttgacccttgaacaacagaggtttgaactatgtaggttcacttatatgtatatttttttccaataaacacattggaaaattttgtgaagatttgcaacagtttaaaaaaaccacaggtgaactgtgtagcctacaaatatcagaaaaattcagaaaaagcaaggcatgcatgaaaacataaaatatatgtaagattagtctattttatcatttagtaccatcaaatatacacaatatctattacaaaagtaaaatttatcaaaacttacacaaacatttacagaccatacctggctgccatttgcaatcaagagcaatgtaatcaagtgtacagatgcagtaataaataataactgcataaaattaattgtagcatactgtacttatagccagctcctattgctattgtggtgagctcaagtgtagcaggtatccacttaaaatgcctggtgatgctaattatctccacatgaccactttacctcttcagtaagttgcactattacaggaaaaagtgatctctcatgattcttgtgtattttttattgtgcttagcgcaaaactgtaaacatcgaataacatcatgggacgtataagaaatcactagtgatactggaagtactgccaagaagagagaagtcaagacattacaaaaaaaaggtgaattgcttgatatgcactatagattgaagactgcagttgcagctgctcaccatttccaaaagagaatccattttgtaaataaacagtggaagtactgtaaatgtattttttcttccttataattttattagaaatgttgtcttttttattttactttgtgttaagaatacagtatgtaacatataaaaatgctttaatcaactgtttatgttattaataagccttcattgacagtgggcaattagtagttgtgttacggtggggttaaaagttacaggtggattttggactgtacagaagttggggatgttaaaggctcaactatatttatgtgtgtgtgtgtatgtatatatatatttggttatttatatctgattatatatacaatatatatacatactctataatacacacatgcttgcacacacatatacacctatatatatatttcaacacagaggttactgaaggtaaaactgctatagccatattgtctctatgatgggagaacctgtttcaaactgggtctaagtgagaaaacaaaacaaaacaaaaaacctctctttggcttaaggcaaaaacaattggaatcactctcaatcgtctctttttttttaacacctaaaaaattctgccagacctatatgaaaagatatccccaaaccaactatttgtcacctttctgcttaaattgctagttaatggtacctcaatatttttgcctggactggtacaatcactttctaataattctcatttttccattctagttatcacaattcattgtcatctgtcagtcagaaattagaatttctgaatttgactgtgacacagtagtttagattaaaatatcatacactcttgaacaactagagaagagaaataaaaatacttcttcaaaaatgtttgattgtatcagagagtatatacagccaaaaatgaagtttccaggatcatggagagaagacaaacatatggaaggaagtggggctttttcttctttttgcccatcaagagttaccaatttctatgaaaggtgggtctagagacaaagtagaaagcagcagcatatgcattctttcaacatatcaaaacatgcagagagcagccaaagcttagaggcaatgttacagccttcaatgcatcggaaatgaaaaaaaaattgctgaattcattacacatatatctatgtatgtatgtgtatatatacatgtatgtgtgtatgtatggtgaatatctatattcatatatatgtatacatatatgtgtatttatacacacacacatatcatatattaaaaacttagaacacacacagcaaattagatccaaaaaagtagaataaagtaaataatactaagatcagatttatttatgtaaatgataaaatccaacaaggtgttcccaaagagaaagagagagaggagagagcaaacatgagagcatacactatcaaaattcagaataaagacagtatataagtaaatatcctatggctgaatagattaaacgttattaaaaattatgccaataatttaaattttatattaaatgaaaaatttcttttgaaaggcaaaatataagtgacatagtaaaatagagaagatagaaataatcctttatttattaaatacattaatatataaatgcaaatcattctgcaaagtaaacttcaagtttaggttgctttacagagaaccttctcaaacatgtaaggaagaaacaatccaccaatttatgcaaactctttgtgacaaaagaaaataggatgtactgtttactttatccaatgatgtttatataactttgtttcataactggatacagacattacaggaaatcaaaattacaggtcagaattttgcattaatataaacacaaaaatctgaaataaatatttgcaagttgaattcaggaaaatataaaaatatcacaatcgaatttgatttattgcttgaatgtaatcttagtttatcatgtgaaaagcagcttaagtaatttatcaaattgaaaaatgaaatagataatagtataattgctatacataagaagtcttttgataaaatttaactccttgcatactgccttgatgggagttctggaacaggcatatacattctccagatttatgagcaagcttccacacagaaagaagatggtctccttaataataaaacttgtttaattgtatagccacattggaaaaagaataaattctgaactctacattaccctatacacaaaaatacattctgagttgatagtatgggaaaaaatatattaaaaagagaagaagagaaatgtttctagaagataacaaaggaaattatcttcattacattggaattttaaaaattatttttatttgtttttcccccttagcacatgtattgttatttattttattttattttaagttctaaagtgcatgtgcaagaagtgcaggtttgttacacagttaaacgcgtaccatggtggttgctgtacctatcaacctatcacctaggtattaagctcagcatgcattacctctttttcctaatgctcttcccccgcccaccctccctcaacaggccccagtgtgtgttcttcccctccctatgtcatgtccatgtgttctcactgttcatatcccacttataagtgagaacatgcagtgcttggttttctgttcctgcattagtttgctgagcataatggctctcaggttcatccatgtccctgcaaaggacatgatcttgttcctttttatggctgcatagtattccatggtgtatatatgccaaattttctttttccagtgtatcattgatgggggtttgggttgattccatgtctttgctattgtgaatagtgctgcaatgaacatacatgtgcatgtatcgttataacagaatgatttatattccatgggtatacacccagtaattgctgggtcaaatgatatttctatttctaaatcttcgaggaattgccacactgtctaccataatggctgaactaatttacattcccaccaacagtgtaaaagtgtcataattaggaaaaaacacataattacatcagaaaagattgacaaattggaaacctttaaaattaggactcatgatagacaccattaaaataatgaaacataattcaacaagatgtccttcaaaaggtaaatgaatgaacagtctgtgtatcatttgatggatatggaatgttattgggaaggaattattattgaaaaattaaaccctataagtcaagtcacaaaaagacttgggaaaaccttaaatacctattcataagtgagagaagcaaatcctaaaatgatacatattatatgatcccaactctgtgacattttggaaagggcaaaactatggagacggaaaagggatcaatggttgccagggggttggggtgaaggaagaaaatatcattaggtagaacccaggggatctttagggcactgaaactattctgtatgttgctataatggcagatacataacattatacagttgtcaaaatccatagagctgcacaatacacagagcaaactgcaaagttaactgtggactttggtcaataatagcatattagtattgattcatccattgtaacaagcatatgacatattactagttgttggcacggggaaagcagtgtttggagggtgaagttatatatatatgtatatatatatatgatttctgctcatatatatacatgatttctgctcatatatatacacgagttctgctcatatatatacacgagatctgctcatatatatatacacgagttctgctcatatataaatacacgagttctgctcatatatatgtatacacgagttctgctcatatatatgtatacacgagttctgctcatatatatgtatacacgagttctgctcatatatatatatgagttctgctcatatatatatatatatgagttctgctcatatatatatatatatgagttctgctcatatatatatatatatgagttctgctcatatatatatatatgagttctgctcatatatatatatgagttctgctcatatatatatatatgagttctgctcatatatatatatgagttctgctcatatatatatatatgagttctgctcatatatatatatatatgagttctgctcatatatatatatatgagttctgctcatatatatatatatatgagttctgctcatatatatatatatatgagttctgctcatatatatatatatatgagttctgctcatatatatatatatgagttctgctcatatatatatatatatgagttctgctcatatatatatatatatgagttctgctcatatatatatatatgagttctgctcatatatatatatatgagttctgctcatatatatatatgagttctgctcatatatatatatgagttctgctcatatatatatatgagttctgctcatatatatatatatgagttctgctcatatatatatacatatgagttctgctcatatatatatatatgagttctgctcatatatatatatgagttctgctcatatatatatatatatgagttctgctcatatatatatatatatgagttctgctcatatatatatatatatgagttctgctcatatatatatatatatatgagttctgctcatatatatatatatgagttctgctcatatatatatatatatatgagttctgctcatatatatatatatgagttctgctcatatatatatatatgagttctgctcatatatatatatatgagttctgctcatatatatatatatgagttctgctcatatatatatatatagagttctgctcatatatatatatatatatatatatatgagttctgctcaattttctgctaaattttgctacaaacttaaagcttccctaaaaaaataaatttcattataaaaatccacagttggaaaagacttttgaaatttatatattcaacaaacaacttacgtttaaaaccttcctacaaaataagaaaaataaagacaattgatgatataaaagaagtgtgaaaaggcacttaaaatgtgaaaaggcatttaaaatgtaggctaccaaatggccaacaaacctaagaaaaaatgctcaaattcgatagtcatcaaattaatggacactaccttcatgaagagatgccactgtaaatcttcagaatggcaaaaattaaaaacttggcaatacctagtgaggatgtagaacaattttcagtttcatatattattggtatatttgaaccctgtcattatctgctggagctgaaaatgcactatcctatgactcagaaattccacacctgggcatataaccaaaaaatttggtacatatgtgtgtgtaaagacatgtgctagaatattcatagaagcaattatccatagtaatgaaaaactagaatcatcccaaatgtccatctacagtagaatgtatacatttgagtattaacaagtgatagaatatagagtaaaaataaacaagctactgcatgtatacatacacttcataaaatgtttacttaaaaacaaaactaattcagattagattgttcctctgctcaaaacctttaaatgaaactccaagccaatataaaagtccagtcaatctaaattcagaatccaatctcttaatcactgggatacattgcccttctttccagcaaggtatgttagttaataggaggacaacatatacataggaaaacaatctttttttttatttttgagacagcatctcacactgtcgcctaggctagagtgcagtggcatgatctcagttcactgcaacctccgcctcccgggttcaagcaattctcctgcctcagcctcctgagtagctgagactacaggtgctcatgttggtgctcaatgttggccacgatggtctcgatctcttaacctagtgatctgcccgcctcggcttcacaaagtgctgggattacaggcatgagacaccggcgcccagccaatctattttttattaattagttaaaggatacaatatcttagtcatacatacataattgcacagaagacctagcaagtgtcacacactcatttcaatgtgtggtttccttagcatcactgtggttcctcactatgggtcaagtatctgccagtgataacgcctggttaaaaatgggatttaaagtataattcctagagaatctaattctgaacctttctcagaggacattaatggcttcatgactactctcaattgtttgaaaaaaaaaatcctggctagatatttgctttctggcctaatgcaagcagatacaagccataataaactatgtaagatagaattcagatactagtcttccatatccatttcctttctcaatgcaggagatgatgaataaggctccagcacatgatcaagaaaattccgtagatcaggtttaatttaacatccaatttccaaatgtaattaggatatgccagtttaggtgaggccagaagtcaggcccacctaaaattctatacatacataaaccagagtcagcacaaatgtcatctttcaaagttcagcacttccctcttcctaaataaattctttctcatctgtttatttttccatgtggaatatctataacagcagagtataatggaagatgtgaaatggttaagcataccttgtaagttttgtagctaaggaagttatttaacacatttaataattttaaagaaaatgagtaaaggtctttgtctttactatgacttaggttcatttgtatgtactggagataaccttggattatgcaagatagaaatgtatttctctagcatactaaaatttacatacatgtaatttagtcctggtcagatatctccaacacctttacagactctttacaactttctctttcatcattcttagggagaaacaaatggcccaaaatagggccctttaaataaatctagattttaaacagaagaaggcaggaaaaggaaaggcaacaggtcataccatgtcctaataatgacacatccaagatgtttgacaaatcatttactcctagatacaagccagtaattggtcaaactgccacatcaaactttaaggatatctggtagatgcaatctttaagccagtggatcatgtatccagtgaaaggttaggagttttgtcagaaagagatgagaaaactgtttctgtgggaaatctcacagcctctgtcacagttgctacgatgtgattaaacgaaaattcatgttcaagtcctactccaaatagaaccactcttcctgtctataggagtctactgtcaagtgctatccccagctgatacaaatagaaagataaccattcaaaataataggtaaatgaaagttttgttttgccttgtctgtaaataaataaacaaatatattttttaaagacttggaaatcaaagaaaaccagaaattattggcagagattgggaatttctgaaagagaatctgactgaagtaaagaatgtcctgggacccacagaccaaaagcagtagacattgaatgatttaaaatttacagcatttcacaaaatttatttaggaaagagaaagtagatatttctacaaaatcccttacactgttattcattgaagataattagacattaatgatgaaaaacctgtttttaatttgtggtttattacatataaatacattaggccacaataataaaaagcccaacttccaatagcttaaccacatagatatatctgatttttgtggatcaagaaatgcagaattagtctagtagttccatgatatcatcaaaatccagagtccttttattttagcttcaagcatctttggtaggcagctttcaactttagcgttcaaagatggctgtatgacatttaagttagatgaaggcagaaagaaggggtaaggctaaggaaaaaggttaaaatcttcttcgtaagtttcctttaaaagttgtttcaagctggaagctttacttagagattttagccaaaatgttattgaccaggattgtgaaatgtggccatcttaaaagaatgcttgggagactgagaattagaagacaaagaaaaatgaggctatcttgacgtcaggtggtcgacatacaatgtctgttagaagtactatttttaaagttattatggcaaacaacatatttgcactaatttttaacacaacttttagaaaatactgagataaaaatgtctctctgagtttttgtaagaaaactatctgacccagtgaacctcatctagaaaatacagaaaagattttacttccgagagtggatatagtctactattattcatctaatatccacttcttagcctcataatacacagatacgtgcacctgcatgggaagagtatgttttccattccactaatattgagctttgttatgtaacctttatttggcttcatgtaaggaaaatgggcatgtgctttgacttgaggtttgaatatctgacttgctttgcccagtgggatatttatgaataagaggtgacctaagactttaaataagatgagtgtttgggtttgttctctagttttttgtcattaaccctgtgaagaatatgctttccttgccacttgtccaaagcagattagagacacaggaagtaaaatgcatttaacccctcatgtggagccaagcccagctgaagaaagcattggtgagcaagaaatcagctcactttcaaatgagtaagcaagatataaatgtttttgaaagtcatataaattttggggtttccctcttatgcaatattattgtggcaatagtttactgaatctttgagcaaaacagctaaatcagtacttctttaaaattgagttttaattattctagttttaaaatatatttggaaatcaggaagtgtgatgactcagccttatttttcttttttaagattgttttggctacttagggttctttgtggttccatacaaattttaggattgatttttctatttctgtagaaaatgtcattgacattgtgatagagattacaatggatttgtagactgtttttgttagtatggacattttaaaaatattaaaatgtctttccatttatgtgtgtctttaatatttttttatttattattattatactttaagttttagggtacatgtgcacaatgtgcaggttagttacatatgtatacatgtgccatgctggtgcgctgcacccactaactcgtcatctagcattaggtatatctcctaatgctatccctccccccttcccccaccatacgacagtccccagagcgtgacgttccccttcctgtgtccaagtgttctcattgttcaattcccacctatgagtgagaacatgcggtgtttggttttttgttcttgtgatagtttactgagaatgatgatttccaatttcatccatgtccctacaaaggacatgaactcaacattttttatggttgcatagtattccacggtgtatatgtgccacattttcttaatccagtctatcattgttggacatttgggttggttccaagtctttgctattgtgaataatgccgcaataaacatacgtgtgcatgtgtctttatagcagcatgatttatactcctttgggtatatacccagtaatgggatggctgggtcaaatggtatttctagttctagatccctgaggaatcgccacaccgaccttcacaatggttgaactagtttacagtcccaccaacagtggaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagttaggttgcgaaaattttctcccattttgtaggttgtctgttcactctgatggtagtttcttttgctgtgcagaagctctttagtttaattagatcccatttgtcaattttgtcttttgttgccattgcttttggtgttttagacatgaagtccttgaccatgcctatgtcctgaatagtaatgcctcggttttcttctagggtttttatggtttgaggtctaacgtttaagtctttaatccatcttgaattgatttttgtataaggtgtgaggaaggcatccagtttcagctttctacatatggctagccagttttcccagcaccatttatttaatagggaatcctttccccattgcttgtttttctcaggtttgtcaaagatcagatagttgtagatatgcagcattatttctgagagctctgttctgttccattgatctatatctctgttttggtaccagtaccatgctgttttacttactgtaaccttgtagtatagtttgaagtcaggtagcgtgatgcctccagctttgttcttttggcttaggattgacttggcgatgggggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatgaaatgttcttccatttgtttgtatcctcttttatttcattgagcagtggtttgtagttctccttgaagaggtccttcacatcccttgtaagttggattcctaggtattttattctctttgtagcaattgtgaatgggagttcattcatgatttagctctctgtttgtctgctattggtgtataagaatgcttgtgatttttgtacattgattttgtatcctgagactttgctgaagttgcttatcagcttaaggagattttgggctgagacagtggggttttctagatatacagtcatgtcgtctgcaaacagggacaatttgacttcctcttttcctgattgaataccctttatttccttctcctgcctaattgccctggccagaacttccaacactatgttgaataggagtggtgagagaggacatccctgtcttgtgccagttttcaaagggaatgcttccagtttttgcccattcagtatgatactggctgtgggtttgtcatagatagctcttattattttgagatccgtcccatcaatacctaatttattgagagtttttagcatgaagggttgtcaagcaaatgctgagagattttgtcaccaacaggcctgctctaaaagagctcctgaaggaagcactaaacatggaaaggaaaaaccggtactagccactgcaaaaaaatgccaaattgtaaagaccatcgaggctaggaagaaactgcatcaactaacaggcaaactaaccagctaacatcataatgacaggatcaaattcacacataacaatattaaccttaaatgtaaatgggctaaatgctccaattaaaagacacagactggcaaattggatgaagagtcaagacccatctgggtgctgtattcaggaaacccatctcacatgcagagacaaacataggctcaaaataaagggatggaggaagatctaccaagcaaatggaaaacaaaaaaaggcaggggttgcaatcctagtctctgataaaacagactttaaatcaacaaagatcaaaagagacaaagaaggccattatataatggtaaagggatcaattcaacaagaagagctaactagcctaaatatatatgcacccaatacaggagcacccagattcataaagcaagtcctgggtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccacctcaaatcgacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataatgaaatgaagcagaaataaagatgttctttgaaaccaacgagaacaaagacacaacataccagaatctctgggacgcatttaatatttctttcatcaatgtttcaccgttttcagtgcataagtctctcagctcattagtttgatttattcctaagtattttattattttgatgctattataaatcgaactgttttcttaattttcttccagattgtccagtgttcgtatataaaaatgtaactgacatgttttaaatctacagtaattcaaacagcattgtactaatataaagacagacatttataccaatggaacagaatagagatcccagaaataaatccacaaatatacagtcaactgatctttgatcgggggctaagaatatacaatggggaaggaatagtctcttcaacaaatggtgctgagaaaactggatatccatatggaaaaaaaaattggaattgtttcttgcaccgcacacacaagtcaatgcaagatggattagatgtaaataaaggcttaaaataacaaaatccttgaaagagacaaaagtggaaagcttcatgacattggtcttagcaatagtttcttggatataacactaacaacattggcaacaaaagtaaaaataaaccagtggggctacatcaaactaaaaatcttttgcaccgcaaaggaaacaattaatagattgaaaaggcaatttatgaatttggagaaaatatttgcaatccatatatctgataaaggatttatattcaaaatatattaaaaaacctacaatgcaatcgcagaaacaaacaagaaaaaaaggacaaaacaaaaaaagtacactattaaagaaagaggaaaagactcccataaacatttatccaaagaagacatacaaatgtcaaataggtatataaaaagatacttaacatcattaattctcagggaaatccaaatcaaactcacaatgatatatcaccttacacctgttaggactaccattattaaataacagatttgggtaagaataggaagacactgaaagcattgtacactattgttgggaaagtaaattggtgcaactgctatggagaagagtatggcggtgccttaaacattttaaaatataactgccatatgatccaacatcctacttctgtatatttattcaaaataactaaaaccaggatcttgattagatatttgcacttccatgcacttctattctatctatgaatgatacttggagtatcattcataatggccgaagtatggaaatttttaattgtccattgatgtataaacggacaaagcaaatgtgatatacatacaatggagtattattcagctattaataaaacaagaaaattctgcaatatgccaaaacatggatgaacctggaagacattatgttaagtggaattagccagtcacaggataaatactgcatgatcccatttatatgaggtatctaaaggagtcaaactcacagaagcagagggtagaatggtggttgccagaagataagagggagaggaatatagggagtttctgttcaatggatagaaagtttcagttatacaagataataagttcaaagatttgctgtatttcatgcctatagttaataatactgtattgtatatttaaaattatttttaaagggtagatctcatattaaatgttcctactctaataaaaaataatgagaaaaacagaattgagttagctgactgggaatggtaaacctgtgacatttgccacataatgctacacactagttatttatatttattcttatttctctcagcagaatattaacttgagagagccaattaaagttgcaatgtgtatgtatgtatccccacaattcttataatactttgcattttaatagttacgaagtaagattaactacaaaaccaagaagtaaaacagcaactattatacttaaaaatcatgagatattcatttaaaagttcttggattttaaatatatttacaggaaaatatggcaagtagcaacaaatagttactatccattcaataccacatgactcaaattcatgttaaatataaggttaatggtagggttcatctgaaggacgacaagcagatgatgtacctaaaatgatttcttcatgtctgaatggttccagatggtctccatttcagacttttcatgactggtctgaaagcttctcttcttgcacgctaataagttagcctgctgtagttttatggatgctggcagaacagagtccaaacataaagccatacatatataatccattcatttcaatcaatgaactgaggaaagcaaatgaagaaaggatagttttttgaacatatagtgccagaacaactgaatgtctgtatgggaaaaaaatgaacctagggtggtatcaatgggaatggtagagactttcaagtatctgtaccttcataacagcaatgacaacactagcaaaaatggccaaaatcaactttttcagaactctggaaatgagccaaagtcttggaatatttacttaaggaagacaataacagaatctttgtaagaaaagtgagttatatggcattttaacttgcctttatcccctctcttcagctgtgcattagatttagaaaacaacagttccacaaacaaggtagctgtgaaaatcagcagcctagcagttacgaaagggggcataaaggatttgaagccctcaaaagccaaatccctagagaattgtcatcatctgacaagcaggaagtgcaagcagaaagtgaaagcagagttgtcagctgcctaagtgttgaatgaagccatgcaccaacacacacacacacacacacacacacacacacacacacacacaaccccggcttagtagagatttggagaattactgtataaaagcattttaagaaatctctgtccaattagtagcttacaatttagttaactgagcagaaatttctgtagccatacaggacaaaaaatacaaagttaacagaattagttcagtaaagtcactaaggaaacaatcaacaacaacaacaaaccttgccagagggggatctgtatcatttttctactgctttaatttaaaaaatgccatgaactacgtggcttaaaatgacacgagtttattatatgtctaaaggtcagagatctaaaattggtctcattggctaaaatcaaggtgtcagtaggcctgtattccttcctgaggctctatgggataatctgcatgttttcccttttcagtttttagaggccccctgcattacttcactcagtgcctcattcttccattactaaaaccagcaaaatatgtttcagtttttctcatgctgctaaatctctctgactctctatcttctgcctttctcttccagataaaagaaccctgtgactacattggacacactctgataatgctggataatctctccatttcaaggtcagctgatgagcattcttaattctatctgtatctttaactgttctttctcatgaaacttcatgtaatcattggttccagagattagaatgtgaacattgttggagatccattattgtgcctatcacatttaagaaaattaaaacctaatacctcatcataatctctagtagtcagaaggcagtgagatgacatttggtgctgaaagattatcaaccaaaaattctactttcagcaaaattattttgcaaatatgaaggagaaattaaaacatgcattaaatgagaacagagagaatatattattagcaaatttgtgttaaaagacatacaaaggaggttctttgagcagaaatgaaatgaaatgaagcatattcacgagttctgggaatcaggatgtggatatttggggacaattattcagcctcccacagaattatcttcattctcataaaggctgtctacaaacatctggcagctagcatgatacttaatgataaaagactgaaaactttcctcttaagattagcaataggacaaaataattcatttctcactcaatttattgaacattgtactagaaattctagccagagccacttgcaagaaaatgaaatgaaaaatcgaaaagaaagaagcaaaactatttctcttcccagaagacacaatctggtatacaaaaaaattctacagaatttaaaaagcatataataacttataaacaaattcagcaaggttgcacaatacaaaatcaacttacagaaattaattatatttttatacactagcaaagaacaacttaaaaatggaatttttaaaatttctattttaaaaattgaaaagtaacaagaaaacaatcaatgtaaatagaatcaaaaataaaatacttagaaataactacgcaaaacctgtacactgaaagctacaaaacatcactgaaaaagttaaggaagacataaagaaaacagcattttatttcatggatcagaagatttaaaagtggcaatactcctaaattgttataaacatttaaagcaattcttttttttttttttttttgagacggagtctcgctctgtctgtcgcccaggctggagtgcagtggcgcgatctcagctcactgcaagctccgcctcccgggttcataccattctcctgcctcagcctcccgagtagctgggactacagatgcccaccaccacgcccagctaattttttttgtatttttagtagagacggggtttcaccatgttagccaggatgttctcgagctcctgacctcgtgatccgcccacctcgacctcccaaagtgctgggattacaggtgtgagccatcgcgcccggcccatttaaagcaattcttatcaaaatcctagccaacatttttttttcccagaaactgaaaagcagattctaaaattcacatagaaacacaagggacccagaatattcaaaacaatcttgaaaataaaagatagaaaaattcatactacatgatttaaaaactgagagctacagtaatcaagatgacatggtgcttgcattaggatagacataaaactatgaagtataattgagattccaagtataaatccttgaacttataataattaatttttgataagcatgccaagataattcagcggaggaaagaatagtcttttcaacaaatagtactggaacaactagttatccatggcaaaataccaagcttgacctctaactcacaacatatccaaaaacaaaacaacaaataagcaaacaaacaaaaactcaaaatagataagattccaaaatgtaagtgctaaaactctaaaacttttttagaaaaatgagtccattttcttgaccttgatttaagcaattttttttctaatatgagaccaaaagcacaaacaataaaaggaaaaatagacaaactgtactttataaaaattataaaattttctgccttgaaaaatcccatcaaaaaagtaaaacaacaagccacaaaataggagaaaatgtttgcaaatcctgtatctgttaaaagacttatataaacaactgctgcaatttaatcaaaaatcacatgaaaatatgttcaaccttatttctcatatatgaagtgcaaattagcacaacaatgagatacctctgtctacccattataatagcttaaaaatcaaagacgtatataaacaactacttcaacttaacattcaaaagacaaacattatacacaaatgtcaataagcacaagacaaaagagcagcatcattagtcatttgagagatacaaatcaaaccacaatgagataccatttcacacctacgaggataactataataaaaaagatgcacaagtgttagcaaggatgtggataaattataaccctcatacattgcaagcaggagtctaaaatggtacagcaattatggaaaataacttggtagttctcaaaatgttaaaggtagagttaccatataatgtttttgatgttgatgaaaatgttctggaattagatagtggtgatggccacacagttttgtgaatatactaaagaccattgaattgtacattttaaaagagtgagttttatgacatgtgaattatatctcaataaaaatgaacatatacacttagttcatgtcacatatatactgaacacaaaatggaccatcaattcaaacataaagttagaactattaaaactttcagaaaaaaatacaaaaaaaaatattactatctttggtgctgtaaccactcaagaatcagaactgaccctcacctaaaatttggttcaaatgtctaacaataccacacatatccctggactatgaaaggtttattactcatataatgaggctcctgggaaaaccaggacaaacttagcactatggttccaaaataggttttgagagcagagcaaagtgactttttatttatttatttgtttgtttgtttgtttgtttgtttatttatttagagatggagtcttgctctgtccccaggctggaatgcagtggcgtgatctcggctcactgcaagttccgcctcccgggttcacgccattctcctgcctcagcctcccgagtagctgggacgacaggcgcccgccaccacgcccggctaattttgtttttgtatttttagtagtaacggggtttcaccgtattagccagatggtctcgatctcctgacctcgtgatctgcctgcctcgacctcccaaagtgctgggattacaggcgtgagccaccgtgcccggccgactttgtgtttttttatggtggtgagacagtggggtaaaggataggggtccctttcaggcctgctttgaactttccccgtgttaaagaagaaaacatgcaagctttcttatcaacctgcagaaatatggggcaagatgagaagtgaatcctaaaaactgtcaaataaaccattaaaataatgagtcagactgttcattacatttggaatacttgaagatttcttaggtagatcaccaactgcatgaacaacaacaacaaaaaaatgaatagagttgacttcataaaacttaaccacttttgttctccgaaagaaactactaagaaaatacaaatcaagtcacagcctaggattctgtatatttgacctttgtacaaaatatacatatataacttgaaagtaaataataagacaaagtaaagaaataggcaaaatatttaaagtctctttgcaaaataagctatataaatcatcactaatcacatgaaaatatgttcaaacttatttctcatacatgaaatgcaaattagcacatcagtgagatacctctacccattataatagctaaactcataaaattcaatagcaaatattgaagaggatagaaagaaaccagaatacttaaatattgctgacagaaatacaaaatgatacagccactctggcaaacagtttgggagcttttagaaagtttaacatatgcttatagtatggctcatcctacccattcctaggcctttccatatgaaaaaagaaagtataattgctcaaaaagacttgcacactactacttctatcaggcatattcagtaaagtcacatctggaagcaaacatctgtcaaacatctgtcaggaggaaaattcccaactcattgtagcttatctgttcaatgaaatcctactcagcagtaaaaattaaaaaaaaaatctattgacacacataaaatggatgaatcaataaaatagtgtgccactgaaaagaaaccaaacataaaggaatacagattgcattattctaccttatatgccattctagaaaagacaaatttaattcagaaaaacaccaggtgagtagtgcctagtcctaagtctgaatggaaggcggagattgtctgaaaagaaatacaaggaaatttttggtgagatcgaaatttttatgactagattgtggtaattgctcaagtgcataaaattcatcagacattatcaaaatgtttactgaaaatgtgtttattttcacttaacataattacctccagttctatgttgctgcaaatgacaggatttctttcttttctaatgattgaataacattccattgtgtatacataatacattttctttttcagtgtatacattgatgagaactttggttgattccatattttggctattgtgaatagtgctgcaataaatatgggagtgcagatatctctttgaaatactgatttcatttattttggatatatacccagtagtgagattgctggatcatgtggcagttctacctttagtttttgaggacctccatactgttctccacagtggttgtactaatttacattcctaccaaccgtgtatgagggttcccttttctctacatccttcccagcatctgttattgcctgtctttttaaatacaagccattttaactggggtgtaatgatatctcattttggttttgatttgtgattctttgatgattagtgatgttgattattttttaacttacctattggccatttgtgtatcttcttttgagaaatgtatgttcaaatattttacctatttttaaatcagactatctgcattgttttcttttgctatttgagccctttatatattctggttattaatcccatatccaacagatagtttgtaaatattttctcccattctgtgggttattactttacttcttttcttctttgtgcataagattttttagcttgatgtaatcccaattgtctaattttgcttttgttgcctgtgtttttgaggtcttacacaaaaaatatttgtgcagatcaatgtcctgggattttcccccaatgtttttttctagtagttttatcatttttgatcttatgtttaagtctttaatgtatttctttttaatttaacatttattttaagtgcagagtacatgtgcagatttgttctatgggtaaacttgtgtcatgggggtatgttgtacagattatttcatcactcatgtattaagcctggttagtaatcattagttattttttcctgatcctctccctcctcctgtcatccaccctccaataggtcccagtgtgcttcatactcttctatgtgcccatatgttctcatcatttagctcccacttataagtgagaatatgtggtgttcagatttctgttcttgcatctgtttgctaaggatgatggcctccagctccatccatgttcttgcaaaggacacgatctcattcttttttatggctgcatagtatctaactcatgatgtatatctaccacattttctttttccagtctacctttgatgggcatttaggttgactccttatcattgcaattgtgaatagtgctgcaatgaacatatgtgtgcatgtatgtttatgacagaataatttatatttctttgggcatatactcagtaattggattactaagtggaatggtagttctgtttttaggtctttgaggaattaccaaccactgtcttccacaatggttgaactaatttatattcccatcaacagtgtataagcattcctttttctctggaacctcacaagcacctgttatttttttcactgtttattaatagccattctgactggtgtgagatggtatctcattgtgatttaagtttgcatttctcaaataatcactgacattgaacttttttcacatgcttgtttgcttcatgtatgtcttttaaaatatgtctgttcttgtcctctgtccactttttaaagaaattgttttttatcgaaatttgtttaagttccttatagatgctggatattagacacttgccagatatatagtttgacaatattttctcccatcctgtaggttgtgtgttcactctgtagatagtttcttttgctgtgcagaagctctttagttaaattagatcccatttgtcaatttttgcttttgttgcaattgtttttggcaactttgtcataaaatacatgcttgttcctgtgcccaaaatggtattgcctaggttgtcttcaagggtttttatagttttagattttacatttaagtctttaatccatcctgagttgagttttgtatatggtgtaagaaaggggccgactttcaatcttcctcgttttgctaaccagttattctagcaccatttattgaatagggtgtcctttacccattgcttgtttttgtcagccttgtcaaggatcagatagtgctaggtatgtggccgtatttctgagttctctattctgttccattggtctatatgtctgtttttgtagcagtactatgctgctctgtttactgtagccctgtagtatagtttgaagttgggtaatgtgatttctccacacttgttctttttgcttaggattgccttggctattcaggcttcgtatttgtttgtttgtttgtctttttggttccatatgaatttttaattttttttctagtctgtgaagagcatcattggtactttaataagaataatatttaatatataaatatttaatctataaattgctttgggcagtatggccattttaacaacattgattcttcctattcatgagcatggaatgttttcccatttggttgtcattcctttttttcctttgggcagtgttttgtagttctccatgtagagatatttcacctccttggttagctgtattcccagtcatttcattctttttgtggtgattgtgaatgggattgccttcctgatttggctattggctagattgttgttgtagtgtaggaatgctagtgattttgtacattgatttggtatcctgagagtttgttaaagttatttattagctgaaggagatttggggctgagactatggggttttctagacaaagcatcatgtcatctgcaaaccgggatagtttcacttcctcttttccaatttggatgccctttatctctttctgttgcctaattactctgctcaggacttctaatactatgttgaataggagtggtgagagaggatatctttgtcctgtgacaggtttcaagaggaatgctttcagctcttgtccattcattatgatgttggctgtgggcttatcatatatggctcttattattttggggtatgttccttcagtacccagtttgttgagagtttttaacataaagagtgttgaaatttattaaaattcttctccacatctattgagataatcatgtgattttgtctttagttctgtttatgtaatgaatcacatttattgatttgcatatgttgaaccaactttgcatcccagagataaagtctacttgatcatggtagataagatttttgatgtgctgctggattaggtttgccagaatctgaggatgtttgcatcaatattcatcaagggtgtcagtctgaagttttctttttttgttgtatcttggccaggttttggtatcaggaagacgctggtcttatggaatgtgttaaggaagtatttctcctcctcaattttttggaatagtttcagcaggaacggtaccagctcctctttgtacatctggtaaaattcagtagtgaatccatctggtcctggacttttgttggttggtatgctattttttactgattcaattttggagctcattatcggtgtgttcaagattcaacttcttcctggctcagtcttaggaggctggggatgtctgtgtccaggaatttaatcatttattctagattttcaagtttatgttcatagaggcattcataatattgtttgagggttatttgtatttcagttaggtcactggtaatattctctttttcatttctaattgtgtttatctggatctctcttttcttctttattagtctagctggtattctatctgtttcattaatttaaaaaaacaattcctggattagttgatcttttgaatggttttctgtgtctcaatctccttcagttcagctctgatttccggtatttattgtcttctagttttgtgtgtgatgttgtgtgttgtgctttgtgttgtgtgtgatgttaggttgctaaattgagatctttctaactttttgatgttggcattcggtgctataaatttccctcttaatactgcctttgctgtttctcagagattctagtgtcttgtatctttgttctcattagtttcaaataacttcttgatttctgccttaatttcattatgttcccaaaagtcattcaggagcaggttattcaatttccatgtaaacatatggttttgagtgagttcattagtcttgatttataatttgatcacgctgtgatctgaaagattggctgttctgatttcagtacttctgcatttgctgaaggttttacttccaaccacgtgatgaactttatattatgttacatgtggcaatgagaagaatgcatattctgttttgggagtggggagagttccacatatttcaatcaggtccatgtaagatgcagtgctcagttcaggttctgaatatctttgttaattttttgcctcaatgatctaattctgtcagtggggttgtaaagcatctcactattattgtgcaggagtttaagtctctttgaaggtctctaagagcttgctttatgaacataggtgctactgtgttggatgcatatatatttaggatagttaggtgttcttgtagaatttaaccctttatcattatttaatgcccctttttgtcttttttcatatttgttgctctaaagtcacttttgtctgaaactagggtggcaatccctgctttcttctgttttcatttgcttggtagatttttcttcatccctttattttgagactatgtgtgttattgtatgtgagatgagtctcttgaagacagcatacaaagagatcttggttctttatccagcttcccattctgtgccttttaattgggtcatatagctagctcacttacattccaggttggtatggatatgtgtgaatttgatcctgtcatcatgatgttggctggtgattctgccgacttgtttatgtaattgttttatcgtgtcacacgtctatgtacttcagcctgtttttgtagtggctgataatgttctttctttctcatatttatgtgcttccttcaggagctctagtaaggcaggtctggtgctaacaaatgtcctcagcatttacttggctgaaaaggaccttatttttccttcactcttgaagcttagtttggccagatatgaaattctgggttggaattgctttcctctaaaaatgttgaatattggcccccaatctactctggctactgttagtctgatgagcttccctttctaggtggcctgacctttctatctagctgccttgaacactttttctttcattttgaccttggagaatctgaagattatgtgtcttagggttagtcttctcatggagtatcttactggggttctctggattttctgaatttgaatattggtctctctagtttcattgggaaatttctcatggatgatatcctgaagtatgctatccaaattgcttatactctccccttctttttcagggacaccaatgagtcttacatttggtatctttatataattccacatttcccagaagtttcgtgtattcccttatttttttctttattcttttttgcctgtcttatttcagaaagccagtattcaggctctgagattctttcctttgcttcatctattttgctattaatacttgtgattgcattatgaaactcttatagtgtgttttcagctctatcagatcagttacattgttttctataatggttattttgtccttcagcttctacattgttttattatgattcttaacttacttggagtgggtttcaacatacttttacatcttaatgatattcgattatattgatattctgaattctgtttctgttatttcaactataatatggtttggctctgtggacccactcaaacctcatcttgaattgtaatctccacatgtcagaggagggacctggtgagaagtaactgaatcatggacgcagtttcctccatgctgttctcattatactgagtgagttctcacaaaatctgatggtttaaaagtgtttggcagtttccctcccaccatcctctctctcctactgcctgtgaagaaggtggttgcttcccccttgccttccaccatgattgtaagtttcctgaggcctccccagtcacatggaactggaagttgattaaacctctttcctttataaattacccagtctcaggtcattctttatagcattgtaaaaatggactactacaagctatctcagcccagttcagaacacttgctggagaggtagtgtggttgtttggaggaaaaaagatattctgactttctgagttgtcagggttcttggattggttctttctcatcttcgagggcttatgttctttcaatctttgaagttgctgacctttgcatgtttttttcttttttaatcgtatttgacaacattaaggatttgattgtggtataaggtggattcagctgactggctttatttctggaagattttatgggaccaacactcagctcccaactcctggactgtgtgctctaactctagggagcttgtattgggccctgactttgttcactggatcattgaggttaggaatccactgcactgttggaaggtttgggactgagagtctcctagactgctggccactatgctctgatgggtagtgtcagccaaaggatttcatactgtagtgacagtgggatccgtcctcattcgcatgtgccagcagcagtggcaatgcagcagcatgtacacttgttggctatggcagggggccagcaggtgctggggtgcctgcctccatgcagttattcaaaacagtggtggatacaataaatgtggctggattggcagagggaggggagttcctgctggtaactgtgcatggagtcaggtggtgttggcacagggacggtgctgttgggcaagggtggttgctcaggatgggggagggtctgctgttctctgtgcctagtttcactcccatggcagtgttggtacaagggcagggtgctggcaggagcagggttggccggctctgtgcccaccaaggttccaactgccattggttggtagggggaggagggttggcggggagtaaactgcactcctgctgcagcagtggcagggcagcgtgcatgtacacatgcacactggtggagcaagaaaagcaacacacacacacaaagtgatatggagggtttccatgggcccctgggaagctgcagtgtgaggacagagcaggtcagctggtgtgtggccatgagggctgccctgctggagctctctgctggtcaggaatggtctagtagttcagaatctatgatggaggcccccagggaacccaaggctgccctgcatgcaggagtggcaaggctggagccccaggagaggtgtgcagatcaaggaccactcaggctaactgacctcacctatgggcaagaatgccctgcagagttcaggtctgacagtttccctaggactaaagtctcctaagagagcaagttaagcctagggggagggccatcgctggccatgcaccactacagatgttcacacaccaaaccgtttgggttccatatcagcttgcttgctgcccctacaacttctctaagcagctctccctgccaactcgagtgtccatggtggtgcaggggtctcctcctgctggaattctagaggcctgtggcgagagtgggttcctccttgccagttcaattcacccattgtcctggagttgttgggggccaggaacgagtcccagtgtgtggtagccctgtgcagggttcccagcttcctcctccttcagtccaacttctgtgtcttccctctgtccactcttggtgcattccttctgaatatttgttatgagtgcacaagtcatctgggtcctttggtggcagctgtttcacctggctggatctagtggcacctggccatcttgccagatgttaattttaatttgatttttgtacataatgagagataagggtctagtttcattcctttgcatataattatccagtttctccagcaacatttattgaaaatactgttctttctctattgtatgttcttggcatcttgtcagcaatgatttggttgtaaatacatgaatttgtatctcttttccattggcctatgtgtctgtttttatgcaagtacaacaccatttttattactgtatctttgtcatatatttgaagtcaggtaatgtaatgcctacagctttgttctttttgctcaggcctgctttgtctatttggggtattttgtggtttcatataaactttagaattttttttctatttctgtgaagaatgtcaccagtgatttgatagggcttgcattgaatctgtgaattgctttgggttactattgtcattttaacaatattaattcttccaatccataagcattgaatatctttccatttttggtgtgtcctcttttatttctttcatcagagttgtctagtttttcttatacatatcttccacttcttttgttggattaatttctagttattttatattgtttgtagctattataaatgggattgctttcttgatttctttttcaaattgtttgctatttgtatttataaacgctactgatatagaaagacaaatatcacatgttctcactcatatgtggtagctaaaaagtggacttcataaaaatagagtagactggtggttacaaggctgaaagtgaggcaggtgatgaagaaaaaaatgtaaatgtatttatcaccactgaactgtacacttaaatgtggtaaagatggtaaaataaaaataaatgttaaaaatcataaaaagtatatatcttatcatgtgtgaattatagttcattaaagctgattaaagataacatgatctcacataatataatttcatttcattttctataaaacattaactttctaggagaataatgctgcataaatacatttgaaaacattttaaaatgaaataatttatgtatttttatataatcaaaagtaaagaagattattgctatgatgttgtgagtgaagtaattataatgttggtctcaagcttgcatggccacaaaataaccattaatttaaaacagagatggactcaatgtactcacagtttcactctatttctcagagacaagggattttatatctttaagtgttttaaaatcctcatataagttatatttgcttttctagaaaacaaaaatattcaatagacagatttaaatattatctttcttcttcctatgtacttaggccaaataaaaatatactgtatataaatgtaatttttctttagtatagaaagttagaaatatatcataatgcatcctattaatattaaagtgttgtatattttgctgatgactggtagaaaattaatttcatgaacaatatgaacttatgcaaaaattaaacaaaatacaaatgttaatgtgaaaattttgtgtttctgttttagaaaaatataatcataagtccttcacttttttgtaagatattcttaatgatttaagactttagtgtatgattcagcccttttgttcatatatttattttcctttcactcctcatttaactctttcctttcttctgactgataatcagcttttgacagttgataattgaagctatcacatcaaagtgatgcaaaaaacattaattaacactaaaaagccaccgtggcacacatttacctatataacaaacttgcacatcctgcacatgtacccctgaacttaaaataaaagttgaaaaaaaaaccactaaaagaatattcaaagtaaaatacattaaaactcacttctccagtttgacacagacaaccagataggtgttagggtaaaaacaacaacaacaaaaatgggaatggttttccttttcctttctttggtattctagccttggtcatgatccaaaggggcaagtgcattaactataccaaacttgctcttggcctataaaataacttttttcatttctagattatgtgcttggcgagaagtatctccactcataaagttcatgtgtaattgaataaagtatacattttgattaaatgtcactcttatctttgggtatgaggcaattcactgcacctgaagaccataccattattacagtaatgtgagtaagcaccagtatgagcattccaccttctcttttccctctgtggacactgtaggaaatgtaatacactcttgacaactagttctttgtctatttaaaccacaaacccagacattcacacttgcttcagtggcaggcaatttttttttctttaagggaagatttaaggagctatgaacaaatcgtttatcatctcttattaactgcactgccaaacttattttaaatgatatctctgttataagtcccatcattgattttattgcctgcaatcattccaccaacttgccttctaggtctagtaatttgttttggtttttgatttccttttttttatgtttccatagcagaagcttccaaagtaaaggctacagattattattattttttagtttttttattgtgtacacaatgtctggaattttccttagaatatatatggtagtctcttggtatccatgagggattcattccaggagtccttcatggataccaaaaatctgtacatgttcaagtctcatataaaatggcatagtatttgtatattgtctacatacatcctctcacataccttaaattatctccagactacttaaaatgccaaataaaatgtaaatgctgtgtagatggttgtggtaatgtatttaaaattttatattatttcacattttcgtatcttttttaatttatttagttttaaaaatattgtcaatctttaattgggtgaatattcagatgcagaactgtggatatggacgactgaatgtattaacttatatagctgtctattaaaatttattctttacttaggactggtcgttgttatgcaatcttctttgttccttataactagagtcctgccttgaaacctaaaccccttataatccttggcattagcaactagttctcacttttacctaattctccagacttctatatatttgatttttgcttattttctttcaaacatctaaactgaataaatatttcatctatcccctaggaagatagcctctgaatcttatttctatcccacttcttttctagtagatgctgctaaccattctcctttccttaaagatgaagcaaagacatattatgtactccttagaaataaataaaatgaatatattccctaaaaataaatagtatgcttttaaaagcaacactaactcttgcaggtaacttagcaaactaaatcataccttatttgttgtactctttaattttctaaggtctcctacttttccagaagatttacatgtttgatatttatgttagtacttaatgtagacacacattagttcaacaaagtactcatgtttcaaaaagcaatatagtagcctgaacaaatccatataacataaacaatttgttcactatttctcaatcaagaatgccatcctaggaatccaatgaaagaagaaactgtcctgctaaaggcttcaatatagcttcttttccaatccatttgaagaaataatatatactccattaggaataagaccatgtctattatgtaccatatatacactatgtacagcaaatgttatatacatatatcttacatagatagaaatagccaagttcaatgcataatacatgagaatctgtaaattttcagtctttcaaaataatacacatgcttaattgagggtaaggatagcagccccctctattattctcaaaaagaaaggggcattggccaactactcatggatgatgtaaacttgtttttagataaaatagtagagcattgacaacaaattttatctttgtaccataacaaatagcttatgcaacattcatttttaaaaaatgcatcataaactatttcagatatgacagtctttgtgttgcaatttatggaacagtgccagttagcatgtgatctgtccatcatttcctctacttttgaaaatccaaattagattattcaaatgtgcactcaaagagcttacccctggaaaccacttatagacttcacggggtacagaatggcttggttgctgattggttttagcctcaatgaatatcacatcaatgcacagcagtctcctatgactaccaatttgcttccctgtttgatgctaggtattgcctgtggtcactaaagccatatttggtaaagggcttcacttgtttactgattgccctttccttcattagcagtcaaaacaatgaagacagcaaattgcatatttaaaatttaactctcaaacttctcaagtttacaatattatattgaagccactttttttcagactttacatccattcagttatgaaatcactctccacaacacatgatttgtagactcaagccagatgcaatttattttattttattattttatttcatgtttgcagattttttgttaggtagcattacaaacaaaatgctctatttacttttcatcatttaatattttattttaattatacttaactgttaatattttgagtttgttatataggttttggtaacaattttaactttaaaattaaaaaatacttttttaataaacatgaaatccctagtatattggcatgctaattaatgaaacttaaacaactggctttacaaattggctaatggattagtcaactctatggaatcatctaattggtaaattgcaaatttacactaattttctaaatactcaaacttctattttaaaataagaatatcagtcaagttatcatagtcatttttatagattctttaacttaggaataggataattttgggggcattaaattaagtgactgaaattcctatactttaaatgacgttaagtgggacaataagctataagctgtatttcagtgaacagaactgtaactactagtagtgataattgattgtactattattagacaatctgtggattcatacatataacacttattcagttataaatacctaataaggtttatcttttgataggtaactcaaaattattgttagatctaagaaaaatgaattcaaataaatttagttatctacagtgtaaatcttccagaataaaatgctctaagaaatttttaactaaagacaaagtaggtttttcttaatatagaatagaaatggattttaacaatgtagaaaatttgtacaccacagtaatttttctgggagcataaattaatgcaggtcaaaggccaaagacaatgttggtgagttaaaaggcaaaaaggcattcaaagaataattttgaatagtccaattgtatttgccaagctgttactgcctcatgtattaaatttagtttaactagctgtaaattaaggcaatagtatggatttagaaacaacctattaaatatggttctgataagattgcatcttaaaggctggcaatctggggacaactacattttaatatgaatgccattttatgtatttattttttgataggtaacttattgctcaatcttttgtcatttttagtcatgatatttttacactttgctttatcatgtttactcacatagagatttggatagagttagatttgacctctcagttataccaagctgatagattaataataataaaactctgacaattacagagacgatttattatattctaggcattctgctaagtctttaacatgcactattttatcttcacattaaccatttgaaaaaaattgttattttccacatatcagataagaaaactaagcctcagataggttatataatttctacagattcacataatcataaactggccatgtcagaatgtaaacacagttaatttggattccagaaccccaacttttagcgatacagcaacattttttatagtagaataaatgtttaactgcaaagtagtcagccacaaaccgttcagaaaccatcaaatctacaaatggaggaatcttgatgagctactcttccagtctggtagttcatctaatagtttcctttctataatctcagaaacgttgtcacccatttttcaaacaactttctactgaagctcttggtagcttaaaatatagcccattctgtggagaaggagtcacttggattgttcaaaagttatttctcataaggtcattttgggcctgcttgtacctttttcccaagaattctagtttggctcttctactctgacactgaaattttccagtatctcagatccttttaacagtcatattgaatatctaaaatgtactagataggcatttatatgtgtgtgtgcgtgtatgtatatacataattaattaaattataattatttatacacactatgtactatatactactatatacacacattattgtatatacacacattaattaaattacataattataactttatatatctatatatataaacaaaaataaaattctaagccacacaattgactgatggacccccctttaggccaagggtattccaaagtacacctgagaaactagttcaggtcatgatgggaagcacccccaccacccacccccaacatttctcattatatattcttcctttggaattcaggcacaactgaccagcataaatgttaaaacagagatcttaagactgacaaagcagactctttgtagcaataagataccaaattccaatttcattcttgaatagtatctcatgacagatagtaggccctgaaggaagttgaggtattttacttcaaaatatatttcattgatatatattgaaatggcctcacaaagctgtcacttgtgggtaaaatctacattctgtagagaatcccctttccctttcaggtccattcctgatccagagacaattcaccaagagagtttgccaccgttttaggtctgataagaactctgaagcttgctacctggaagcttcatctgcataatcaaaaccttggtctttacaacctcttcttttaaccccacacttctttctactgatttcaggtctttagataataacttaacactttaaatcacttgccaatcagaaaagtctttgaatctacccctgacctatataagctttgagttgtcctgcctttctgaactgaactaatgtataccttacatgtattgattgatgtctgcctgtaacttctgtccccataaaatgtatgaaatcaaactgtacaccaaccaccttaggaacatgttctcagtacttcttggtgttcatggttcacacagtcatctcagaataaatctctttaaatattttacaatatgttacctcatttaactctcaccatatatttatgaagtagatttttgtcatttcctttaaataggccaggagaaattgaataattgcccatagttacagaacaaataaccatggatagtaactatgtcttttgacttcaaattcattttgccctagagaatcaatcttacaaatttacaattcaatggtttttgcttcataatagatgtaattataactctcacttacttttcatttctgtttattctgcccctgttttgttatgaagtgtaggagctctgggttttgtatgctgctttatgtttgcaaataaataaagcaaggcctccctgactcctagactgaaatacacctattcaaataatggttccaatccaactgattccctttcttcttatcttcaaaagaaaaatacagaggtaatatctaggaaaaaatttcatgcaaaatactctaaatataagctcatctttaactagaagttcatttgtgaagacaaagcaaacaacaaatgaaatactgtgaatacataatttagagtgaaagcatttgcagtctaattattgatatcatagtaattatgttgcttgaaaagcatctttaacatatttatttaaactaatattatttgccaatgacccgtgtatttcacgcataaaatggatgacctaatttaactcaattaaagcaacatgaaacattacacgttttaccaatattaattttcacacatcataatttttgttttataattcttaacaattaagataaacagattatatttgtctacaattttttaaatgaaattatttcttcagaatagagtaatgcaatgtcatgtctgattttcagtacaatcttaacaatacattatgtattaaagttttttaaaccctgtgttcactgtctgtaagtatagataaatctcatttaaagagagttaacagctgattcactcagcttccccttccaattgttaggtttgagtcctgtaattagacagcataacagctaaggtacttttttatcagcttgccaaaaagggagttttagttagtgatacattatataatgagaaacctccttcaacaggacttttaaaaagaacttgtacaaatctaaacaattaatcctcctggagcattccaatgaaatcactaataaggcatccagaaatgcaaatacctacataaattgttcctatgtgaatttggagtttgggattatcacatttgtttttgccctatcctggagaacagttagttttgttagtaattatactcttcaagcctttatttgtatgaaagtttgaattcaaaagagatgtgtaaacaaaacatacataaaattattgtagatattttcattatgtgttttcttaatcttgtcagtattttgttgatgaaatactgatacgattatctacttaattaaatgtaattcatttgtatacaactataatgaaacattagaaatttaaaagataataatgagtacaatgcatataaaatgcaaaagttctatgactactttaaagaaccatccatgttaatacacagtcttgtggatatggcagcatacacctccagctaacctttaattttttcattattataacctcatcactgtcttccactaaagagactttgttagacaaaggaaaaagaaaacacatatctggatactataacagtcacctataatcattatttacataatatgaattccacagttcataaaggacatagatttgcaatctaacctttggaagtgtaagtgtcatgtattcctgttaagacatggatccttgatggaagcatagtcatttgctaataggtaggttcttaataaaaattttgaaaaaaggaaataaaatcatattttaagagatatgataatttaaaactttactaaacttaaaatgagtcttcagttaaggggattcattgtataatcaaacaaaatccagaagtcatgaataatttatgctgaaaattataaataaaataaaacctctttaagcattcaggtagtaaaaaatggttatcaatagagaaacaaaaatttagttgaggacaatagtacactttctagagagttttaagcagaaaagattgtgattcaataattttctatccagcagagacctgccatacacagacaaatttgtagaaaatataccacccatgtgttctttcttgagaataaaattaaaatttaaaaatcaacagttattgtggaagtcagtgtggcgattcctcagggatctagaactagaaataccatttgacccagccatcccattactgggtatatacccaaaggattataaatcatgctgctataaagacacatgcacatatatgtttattgaggcactattcacaatagcaaagacttggaaccaacccaaatgtccaacaatgacagatgggattaagaaaatgtggcacatatacaacatggaatactatgcagccataaaaaatgatgagttcatgtcctttgtagggaggacatggatgaagctggaaaccatcactctcagcaaactatcgcaaggacaaaaaaccaaacaccgcatgttctcactcataggtgggaattgaacaatgagaacacatggacacaggaaggggaacatcacacatcagggcctgttgtggggtgtggggagaggggagggatagcattaggagatacacctaacattaaatgacgagttaatgggtgcagcacaccaacatggcacatgtatacatatgtaacaaacctgcacgttgtgctcatgcatcctaaaacttaaagtataacaaaaaaaaaacaacagttaaggctttttcatacttgttaacttagttataaaagtaaatgtctctttaatagtaaatgatacacagtattgatagtaactcagtagattaccatataaaattatatatattttcaaccaaaaaggaaaaaaaagtgaagaaataaataataataatggtgcttaatttcagttttgcatgccctgtgcggtcaggagtcatttctcacttgattgtccttatatttctcctgtccagaacaatttctggcacacagtagaactttaattaatatttgttgagtgaacgcctctaatttggggacaatgaataaatactattttattcttgacattgatgattctagagccatgtacatgaatatacatccatacttaaaggtgaacattggttgatacaaataattttttttgggccaggtgtggtggctcatgcctgtaatcccaacactttgggaggccaaggtgggtggatcacctcagctcaggagttcaagaccaggctggccaacatggcaaaaccccgtctctactaaaaatacaaaaattagccaggcgtggtggtgggcgcctgtaatcccagctactcgggaggctgaggtaggagaatcacttgaacctgggaggtggaggtggcagtgagccaagatcatgccagtgcactccagcctgggcaacagagcaagactccatctcaataaataaataaacaaataaataaataataaaaaatttatttgtatttgaaagcctaatttttaaaaagtcttaaatcagagtctgagatgagaaggcacatgaggcgatatgattagggaactggccaaagtactgtatagacagccaggatggcattgatttttcagagttaagaagagaggaattagatattcaacaggagaaacataagcattttgagaaacattattctcaagttggcagggatccaaggaaagaatagcttcatgagagtctgtgaggactgcaatggctggacaccaggcactacagtccagaggatctcatgatggagtttacatggagggattggatctttcagtaatgcctgatgagtttaaacatacctgttttggaataggtaaggtgttatcagctggggtcaccagaagctgaaatctagggcttaactcatattcttttactgataaaatatttcatattaacgttatggtgtctgtgctcaaagtgtaatacttcttttttttttttttttgagacaagagtcttgctctgtcgcccaggctggagtacagtggcactatcttggctcactgcaagctccacctcccaggttcatgccattctcctgcctcagcctccggagtagctgggactacaggcgcccgccaccacgcctggctaattttttatatttttagtagaggtggggtttcaccgtgttagccaggatggtctcgatcttctgacctcctgatctgcccgcctcggtctcccaaagtactgggattacaggcatgagccactgtgcctggcccaaagtggaatacatttatataaggaaataaatgttttgtttctcataactactgcatatgcataatttaataggttatttcatttttatttatatttttcatatattctaaaaacttttttttaattattattatactttaagttctagggtacatgtgcacaacatgcaggtttgttacatatgtatacatgtgccatgttggtgtgctgcacccattaactcatcatttacattaggtatatctcctaatgctatcccttccccctcccccgaccccactacaggctccggtgtatgacgttccccttcccgtgtccaagtgttctcattgttcaattcccacctatgaatgagaacatgcagtgtttggttttctgtccttgcaatagtttgctgagaatgatggtttccagcttcatccatgtccctacaaaggacatgaactcatcattttttatggctacatagtattccatggtgtacatgtgccacatttcttaatccaatctatcattgatggacatttgggttggttccaagtctttgccattgtgaatagtgccgcaataaacatacgtgtgcatgtgtctttatagcagcatgatttataatcctttgggtatgtacccagtaatgggatggctgggtcaaatggtatttctagttctagatacttgaggaatcgccacactgtcttccacaatggttgaactagtttacactcccaccaacagtgtaaaagtgtttctatttctccacatcctctccagcacctgtttcctgactttttaatgatagccattctaactggtgtgagatggtatctcattgtggttttgatttgcatttctctgatggccagttatgatgagcattttttcatgtatctgttggctgcataaatgtcttcttttgagaagtgtctgttcatatcctttgcccactttttgatgaggttgtttgattttttttcttgtaaatttgtttaagttctttgtagttccagtattagccctttgtcagattggtagattgtaaaaattttctcccattctgtaggttgccttttcattctgatggtagtttcttttgctgtgcagaagctctttagtttaattagatcccatttgtcaatgttggcttttgttgccattgcttttggtgttttagtcatgaagtccttgcccatgcctatgtcctgaatggtaatgcctaggttttcttctagggtttttatggttttaggtctaacatttaagcctttaatccatcttgattaagtgtgactactgaagctaggtatttaaagtcatggtggcttccaccatagcttctgctggatgacttattctggagaaagccagcagccctaaaaacagctcaaaatgttgagagactgaggattcccaaaaacaactaacaatcatttctcaggcaattaaatttgagccatgttgaaagcaggtatagcagcccaggttaagcctcaatgtgactgtatcagggtcaacatcttggatgaaacctcatgagaaattctaagcttggctgggcgcggtggctcatgccggtaattccagcactttgtgaggccgagacatgcagatcacgaggtcaggagtttgagaccagcctggccaatatagtgaaaccctgtctctactaaaaatacaaaaattagctgggcgtggtggcacgagcctgtagtcccagctactcaggaggctgaggcagaagaatctcttgaagccgggaggcggaggttgcagtgagccgagattgcaccactgcactccagcctgagtgacagagtgagactccatctccagaaagagagagagagagagagagagaaattctaagctgaaaccactcagtttgaatttgggaattcatatttttaaattttgaatgattttgagataataaatgttcgttttccttttaagccactgaatttgaggcaacttattaggcagcaataggcaatgaacaaaacatccatctagaggtacacaagggtgggtgaggtatctcaaatatttaagcagtcatatttttacttggcctatccttaccatacatactcaaagcaagattttcagattgaaacaggaaggttgtttcaaagagttgattttgaagacattgttcattgaagttacctatggtaacactaaaggtctaagttaaaggagcccaaacgtaaggttttgtaaagtaagataaatatacaacacctttcctatccttcatgttgttctctatagggagacataatccaatatagactgagaaaagaaatgcttccaacaaagtcttcaattgcaacattattaaatgcactttagctagtgaaaatatgttttagatatcaaaattactttgtataaaatcagactaaatttatgaaagtcaaccagaagtcagagcaacataaaatttgtggactacgatctgttgaaaatctatcaatgactggtaaatacgagatggtagattatgcaaaagttcaaaatactgatttaaaagttcaaaatgatttcacccaaaatggcattgacttgttattgatttaaccaaaagcagtccaaatttacacactaccacatttaaaatttacaaaataagcagctgaaaatggcaaattaaaatgcattaatcaattgcttgacaagtctagattttataactaaagaattatgaaaaactcaaccaagttatacaagtagataattttagaagtgaaattgtattttaagttaaatgttacttagtctaaagctattacaaatgataggaacttaatcacttttattcatttttaatgatttataaaaatgtttcaaccatggatgtcaacattgattcatctccaacctgattttcactcccaccttaagcttcatgtcatctttagctttgtataagcaaatcaatacaggcatgccaaataaattctatttctgtactcacttctggtttaggcttatgtcaggtaccctttccttgtagttcatccaagtatttattaaaatgttcccaatgatgttgataaaggaaagcaaaattaatattctttaacaaaaacatgacatttgagcctttataagtgtctgagaggacttgtcactaactagaacagtggttctcaacctgtggactccgagtgagaagcaccagtaacacctgaaaacatgttacacatgaaaacttgtaggatcccaccttagacatgctgaatctgaaacgctggggaaatagggctcagtgatattttaacaagccctttgtgattctaagacatgctaaagattgaggaacaattagaatgtagaagaaattggactgatattcatgatgtggactatgcacacctatttgcaaaaacaaaacatttcacattcaggaaataagtaggaagaggttctactcagctccaacaacaattcctagttcagaaatacagaatctgttactcaaccaaaataaaaaccaaaccaaaggaagtatccactctaactgtgtagacaccaccatctgaggaactgtgggagagctgtttttctcctaccttagctctcaaccattatgttgtgggccatttaatttttcctacttctttcatggcatttttgtgtgtttttattatttaatacatatcttttcctctcatagtaccttgagagtagtggccatgccttttctttttttgccactgaatgtccagcaactatatcagtacctgatatgctgtagaaacttaataaatatgctaaataagcatggaattaatggattaatgacaaagtgaatgaatgctgcactataaactgtcatgtctgtatcagttttcactggattcttctgaactattattgtaactggcacagggcaagcacataataaatatttggtcaattaataaatttactaatgcatcaaaactattttcccaacttgcgctttgcctttaaacttaaaaacattttaaacttacaaatattttttgattttatatattcaaatatagtttttgtctttttgggggatttctctccataattctaatcattaaagcctcccattaatatattcctaagtctaactagacatatgttacttttattttgctaatccctacttctgtttaaagaaattttattttgtttacttaggattagtcaatgaaataaccaaactgagtgggttctgttttatatgattaagagcgttgatgagtaaatttttcacacacatatacagaagagttcaaaaaggataaaatgataaagaaattacatagcattattagttttatattcctaccttattaatcatatggcaatttttatatttacattaatagtataataatcatatattattaattttatataccttattggaaaattcactaacaaattccacatttctttttttaaaccttgaaacattccagattaacacccagaaaggacagtctctgacagtaaaaatatataaattataaaaatttaaaaaattccttagattattctgtttctcttttttaagacatggtatttagctatctttgagggtttttttaaatagaagtgttggaattacatatctactatgttccaggtatagtactaagtactttttccacaattgcattaatttatatagaaaaattctaacataattttttgcctctttatttttcagaatagaaaactttcagataatgtcagcatttctgtagggaaacattactagtattttacccaagaattatacttaagtctatttgattccaataatacatcagtcaactcttgctgtgcaaaagataatccaaaatctagtgacttaaaacaatgaatctttattattttctacaattctgtggatggctaatggttcttttagtctatgcgtttagctgattcctctggtcaggtggtggctttactggggcctgacagtctgggaggtccttattcacataccacgcagctggcccactctcagccacagtgccacatgttattttctacatggactcctcatcaggggggctcaggctattcacacgatgatataaggatactacattcagctagatagtgagccccatttcagaagctgtttcacacttcagaatcattagttgattctgcttccatatcaactaatgtctcagtggccaaacaagtcacatagccaagcctggattcaaagagaggagaagctttccacaatgcaatttttagaacaagatctgaattgtgtgttttccaaataatctaaactgtacatactttagataaaatcatattcctgcatacatatttgagaagacatctaatattttcatggaaggtgactaaaagtttgattattattttttggaaaacatatacaattgctcagaaatatgtttaatcaattcaattatattttaatactaatttgcaaagcaatatatatgttcttggtggatttatttgtatcctcagtttatttgtgtgtaacattttgatgtttatttctataattatctaatgtttctgaaagttaattttagttggatagtgatcaagaagtagaagccactccaacctcaaaggaatttgttgattaaaacacatggtctatacaaacattttagttactgatcctcaattaacatgctttatctcaagtgtacacaatgtgtttttgctacaattaagtacagtatacatacagttagaatgttgtctattaaatatagcactgcttggccaatcaaatcattgtactgtggaacagggaatggcttgctataaataagaaagaaagacatagcataggattaaagaaaagcagatacaaatgcttatttcctggaacttagaaatatagtaccttagtagtgaattgtagcatgtagtcagggaactaaactgttatactcaatagatacattattcttagagatatgaaatgaaaaaaagataactgagtctgcttttatgttcaccatgcaactctttaaatttaatagtgattgttttatactcactgttaacctacttaacatttttagtcttttattttttataagttagcctccaaaaattctatgtccaaagtgtgccttgaactcagaaacattcataaatatttctcgctatggatctaaagggataaattaggtgatgatcattcaacttacaagtcaatttgttacagtattcctttcaacagccaccctctggcatattaaaatgtaaatcaatttataaatgatgacttaaatgatgacttatacacttgctgagagagtaatgcaacttattgacatgaagattgcttgtaaaagttttcaaatatgaatccatttttctaaaatagatgcaatagcaattagataatatagtacacttttttctaaaatgcttaatatgaaatggtaattttgataacctcaagtagatactatgtcacaaaatatttatttcaaatagaacaaactcagtctatagttcaatataggttgaataattttacataaccacaggctatgtctcttctaaatatagcacatatttgatattacatctcgttgccagattagatgacaagcaatattcaaatcaaaaaatcctcttgtataaacagactgttactatagtgtcagattatgattttcaattaccatatgtttctaaatgtttgtttaggattttagaaacagtgtgcttttttctctcaagcaataaaataaaataagcctttattttggtaatatttgaaagtataaatagtggaaagagaagacaaatgaactttaactctcggcttgatagaagggaattatggtattttggcctagaaaaaaaaacaaaaactgaaattaactcaaaaaaccagtcaggctcacaacaccaaaaaataaaggtagtaagaatactgtcatagaagcaaagttctatttcttttatgaatgtgtcagtgaataacaacactacttgaagctttaaactgctattataaaacattttcaaaagattatattttttcttatcatgatataaaattaccagaaacattttaaaggttatttgctatgtttcctacaattaaattaataaaataaatagatcccaatgctcaaaacgttgacgtttttgaattatggtcatagttctctttcgatcacatctgaactagataattatggaagtgtataaatctgtataactgaattacagactgaaaggccttaagcttgtttatgtattttgctttattctttcatattgtagtatcaaacattcagaaaacaattttcatcattgaccttcagaaactctttactttttctaggattataaagttctatctctatttattactgcattcaaaactgaaatttataaaatgattaaataattatatattattctatatactaaatagccgtcaacataggatatggaagaaaaagaagctcagtttttctattgcatctctgcatggacacttctgaaacttggtaggtgaaaaacttggtaggaaaaaaattttctactgattactgaggataaaatgaaaccatatgtctccaaacatctttaaattcacaaaagacttcctttataggcatcaagtaaaactaaactttgacttaaagttcacaaagttaagcagaggcaaattttaaaaatgcttttggtggaatagtttatagaattaaattttacctgctgtgaaagtgtatttactccaacactttaaaaattgtatttttttctaagctgtaagtacatggacacaaatagaaatacatttatctgaaaatatactgaattgggaagctgaaatgtcataaaacccttctaaaataatgtgtggggatagtcataactgagaaggcatcccccaaaaaacaccactgtctagatgccgcctaaaagcgtcatggtaaaaacagaaatgctaggggaaaatgtaggagaaaaacagagtgggttgagcccatggtgttatttctaaaattttgacttcgaggacattttaaatatattttaataaataaaaagaatttatttattattatggcaacacagatatattatgtaaaaatttttttccagggtaaatcagatagtaaaatttattgattaatgtccatatattgaagttgcttttattttcccatgttttatttttattttgctataagaattttcaccagggttaatgttttctgtaaattttagaataaagtttgacatattaatactttcttttttgcttatgcaaagttttagtaattgtggcctttgccaaagtgaagcttgtttttcttcttcttcctctgcttcctcatcctcttcttctccccttgttttctttcctccccccttcctcttcctgctcttccttttgctcctccttctcttctttctttatcctcttatcttcctttattcttatgaagtccaatatttctaatcatttttagcacatctaaatgtttttaaaaaatataatattcatgtagacaggcatttttgactgtttatctcattgatatcttacctgtgcatctaaaaatgcctggttcatagcatgtactcaaagataccaagagaaattttggttaacacatatgacaatgtccaatttaagcttgtatctgttagatgttatttgctcagaaaattaaataaatatttggtaaattttgtttattacttggaagaaaaagaaaactaatttagagtagagttaaatgatctgaatatacgatgcagtcagaacacaaagtggtggaattaaatcattgggtcaaaacatcatgaattttgctaagtcttgtctgattaggcaaaccaaccacaaaaagagacagacaaacatattccctatttgtgaagatgcaaaatttctggaagttttcagaagacatgaattcactttacagggtaggcatgtttttctgccctaaaagttcctattcaacactttggttggctttttcttgtatttcagatctcagttcaaatgtcaactttgtgagaaatgtattcccattaggttatctgaagaagtcttcccacctccggtaattctgtagctcttaggatcttcagatcatgatacatacatatgcacatgcatatacatgactgtatgtgtattttatagttgtctgtctcccacattagaagctaaattcatggagggtggagaacaggataaccttctgtttattccagttgtatactcaggatcaataggaatatgcatggcaaaaataagtcaaagtaagaaactgaagatatttccttgtgttaaaagatgatccacactgggagggcatttttcttgattttttttaatactgggaaaacatgaggtgctcatttaatatttgagaacttaagatgtccacaatagaataatctctcaaggttaatttatttaatatattccccttaagtgaaaatatgacagttaacatacttcttaaaagttgttctttctctttctcacaattccctttagttaatccccaattcccaatttgctttagcaaattcccgtttacgcaggcttggatacacggaataaattgtgaactatcttaatggtctactgtgtagcatacaaaacaaagggacatcagccagatgaacattttaggcaaaatctaagataaagaatagagtagtgattaagagcacagagcacagagtctgcagacacactgagtttgtttcaaatcccagctcttttcattattgagtgtgtgatttttgagaaatgtacatgattactagctgggccatagtctctttatctgtaaaatgtaataaaaactactcatacatattttgtgaagattagataactcactgtatgtgaagaatttagaactgtgtatagaatgctataatcaatgtgttttatttattatttttaaatatgtaagaaggaaacttctcgaaaaggatggaagaagctaattccaaaggagatttattttgtaacctggctctactgctaactggctttattaattctttcatctgtgaaggcaatacttcctgcctacttcacagggtaatactgcctgcctacttcacagggattttttgagttacaatatggaaaatccttaaaaccagataaggtatatagtagcactctataaaaagtgaactattttattttgttaatgattttaacattgactgtgatgatcttacaaaggtatccaagatatatgccaaaatattaagagtactatcataagatttctggcagctttttaaaaaattgtatacatacttaaaatatattgtatataatttttaaataaataaatacaagaaatattagtgctttttgaacatgaagttcatctgactgccaatgtttcatcagaaagattctataaagttgctcactaatgcatattactatatttctgtcaaaggcatttaattattaagtcatctgaggagtttaattgcttgttatacctattgacttacagttggaaatataatgtgattttctttttaatttgaagatgataatttacagactaggcttttctcattttaggtttaatgatgctttatttcctattggaaagactgttttgtttctcatccccaaacattttaataatgcttctacttagagtgttaaatgaggaatgacaagtttaaactagtattattttgtgggtagctgagtaacgtcagcaagacgcctcagaagagatgcttgatgctcaccaccaccacaaaatgaaccacgacaacccatagacagctaagatttgactggagggagagtgctgaaaacaatgggaaagtggaaacgcacctatggtgattggaagcataggaggacatatggagacacccagcctctgcagacactctcccccacttagattgacccagagtcgggagtgagttcctgttgtggggaaagagaagcagactgataggatttggttctgtgtccccacccaaatctcatcttgaaatgtaatccccacatgtccagggaggaacctgtaatccccacctgtccagggagcaaggtgattggatcatggggcagtttcccccaagctgttttgatgatagtgagtgacttctcatgagatctgatggttttatatggggcttttcccccttcactttccctctctttcctgctgcctcgtgaagaaataggtacttgtttcttcttcaccttctgccatgatcgtaagtttcctggggcttttccagccatgtggaactgtgagtcaattaaacctctttcctttataaactaccctgtctcaggtattctttacagcagtgtgagaatggactaatacacagaggaacctcaccagtcccattgccactccaaacacttacagtctgtactatagggaaatcccacagtccttgaaagccctgaggccactttgaatagctgctgggaattcacacagctgcattgccatgcattagaagcacaaggtggacaatctccacccttcatctactgtgaccaaactgcttcagcacagggtcatctggaaatgagtgccacctctggagtgtgccctgctttgaggccagtaggcactgcacctctccagcactggggcttcattttcattccaccaagtccacaaaggtggcttaacaccacaatatcactgtgctaagcttggcccagtatccgctatgactgtggtcctgcagagcagggaaactaacacccacgatcaacactcccagctggagaaacagtctggcactctcactcagtgcaaacctgcccataagctagccaaaccactgtacacccctccctagtgggaaaagtctctgagttaccaagcagttgacatgcaccctggctggcagcataaatacatgcccacgcctggggcctgacaaatagccctacagccctacattgcttccccactctccatggacatttctctgccgggcccaatgtgggtgcctataatcagggccggggaaacagccgtgcctgtgggtcacccctggcagacatgcccccaggccagctgatcagtcacgtgcccacatctcaagcccaagacagagcaccaattgacactctttaagggaacacacccagggctactgagcagctttgtgcctgtatccaggctagaaaaatagccctagggactgcctttggtgagcatgcccccaggccagccaaatagctatatgccaatgttatcagcctaagaaacaaccctttaaggttcccctggtggtcaagccctgaggctggccaaacagacttatgaccatatcccaggcctgataaacagtcttttgggccagaccgggcaggcacatagccaaggcagccaagcagccttgcacatgtgtcctgggccttagaaacagccctgtggactgttcccagctgacttatctccaggccagactggtagaaacagcctcatgggacatctctggcagacattcctccaggccagccaaacagctgtgtgcccatgttccaggcctcagaaacagtcccatgggctgctcctggttgaaacacccccacattggccaagtagccttgtgcctacatccaaagcctgataaacagccctgtggttcactgccagcagacatgcacgcaggccagctgagtaactaggtggctgtgcccccacccagagtaacagccttatggctctaaccccagtgaaacagaccttatgatggcaaacccactgtgtggacacacgtacccccaacctgagaaacagcctaataaggcaacaccaggcaaagctgcaccaccactgccataaattctctcaacttaggccactgagatgcttgcaaatgtcactagcatggattacatctgaagaaactacacagagattacactattgtgtccaactagaaccaaagccagtgcatcccacctaatggatacaccaagctccacctatacaaataagccttcccctagaaaaccccctccataaagttggaagaggtaactgttttaccagatgtgtaggcacacattaaacattaaaaaaagcaaaaaaaaaaaaaaaaccaaaaaacagacacttctaaaataacaaaaaattatccagtaatagacctcaatcataaggaaaaatacaaaattcaaggaaaagaatttattgtaataatctgaagaacactcactgagacacagaaaaatatagacagaaaattcaacaaaattatgaaaataattcactattatttttattactcacttaacgtaggatattatgttaagtgaagttagtgagaaattgaaagttaatcagtgcatgttcttactcatttgtggaagcaaaaaaggtgatttcctagaagtataaaggagaacagaggataatacaggttaggaagggcaaggggaagaggaagatacagagatttttcaaagaatataaaattatagctacacagaaaaaataagttctagtgttctatgccattgtagattgactacagttaacaataatatatcatataatttcaaatagctaaagggaatatattaaattttctgaacacaaagaaataataaatgtttgagatgaatagttattctaattaccttgatctgatcattatacattatatgtatcaaatatcactatgtacttcataaatatgtacaattattatgtgccaatttaaaaatatacaatcaatacatacaaaataaatagaattaggaaggtagagaatgtgaaaaaataaaaacagttataaattaatgtctgtgaaataagctattaattttctgagggtagctcagtaactcttgtgaagtaaattgcataactatatctctcaattttaatgacttgcatcaaaaatatgttttaggctgatgtaattgtggttttaccattacttttaatgccattattttttaatttgttattacttgtaatggcaaaaccacaattacttttgcaccaagctaatataagtacaagtcacattctagtttgatattagccataatattttttcttagtgatgaagaatacagaaataataatcatttgctttttctagatatcatactacctaggtaagtatttcttaaagtaatttcagagcttgtgtaccggcacataattatcaagcaaatcacttaaggtcaattttatatctaatacatggcaataaagttgcagtccagtcagcaaaaccttggcataacctttattctgttcagaaaattctattaattctaattgttgctggcttaatgaaagtgtgattcaatattctatattgaccttgggccatttctttttaggggtggtcatgtcactagtaaaggtataagagtcatttttaactttaaatatttaaactcacacctactctaaattctaagcaaaagaaaactgaataaacaaaattatcctgaatcaataaagcttcacaataagtttaccctagacttttaaagcccataactaagtaaatccagttttgttcataactacttcttgccaccctcctcactattatgttatcactcccattgaatcagcttcatactgccctagaaacttgttctataatcgtttatctttaaatttgcaccctccaatcatttgttttacctgaaaacatgcttcttcctgatgacaccagtttacctatagcttgcttgaacacatgactacacgttttttctcttcccatatagcacaaagactttaagaatacagtgacataaagctagctctctcaaatgctaaatcattgctattaggcccatttttagaaattgtaattggaagcttgactttcagttgtgccatcctttactacttcactcatctaagcataaatatatgaatacctgcctctgagtttacaaattaattgagaaagtcagaaatttccagaacttcttggtctcctacccatttataaatgcttccaatttataaccatgctttatctcttccttccatttcatcatagaaatagtcctcctatttaatgaaactcatatctcagagaccttatgtttgtttcttccttttttttcatagttttcaacctctctttaccttcaatatgcccaaagttctcctatattaaaaacacacagcacgtaaacacatacacatacatacacacacacacacacacacacacacgtgttcaggcactctcatgtccctttctgttaagtatttacatttctcatatttcttaaaagtcaaaaacacttggtcttcaccactgatctttagttcaccacttgacccactgctgcatgctctctatccctgacatgccactgaaatttctctgaatgaggtcactagtgctctattattaaataaaataaaccatcttcaaaccctgattcacttttaggtacacttgtcattatttgctacttccttctatttgaaattaactcattttttgtctaccatattgcccagctttgctgcttttcactaccatactagtctgtgtatccttttcacaagatcctcttctgtttccccaagatccttcttctgttaattgtggatacttccaggacttccaggtgctcctattttgtcttcaacttacatattattcataagaaagatctcatcaatacatgtagtttcaacaatcactatgttattgcaaccaccaaatcatatcactagactcattttctctttcttactgccagatatctctattaggcctccaactgaaactcaccatttctatattagctttctattgctgctataacaaattgccagaaactctggtttaaaacaacataaatttgttatcttacattttggagatcaggagtctgaaatgagtcttactatgttggaaatctaggtttccacagggctgtattccttctggaagttctagaggagaattcatttctttgctttttcctgcttctggaggtaacccgaattccttagcttatggccccctcctctgtcttcaaagccagcagcataacaactttaaatcttttatttattttctttctctctctgacctgtacttagatagccatattttcatctgacactcctgcctccttttccttttaaggggcttggtgacttaattgggcctatatggataatactagataaacacccccatttcaggatctttaattttatgatctctgcaaagtaccttttggtatttaaagtaacatattcacagttcaggagactggaatggggacatatttagtgtaccatttttctgtataccacagtgtccaaaaaaagacagtaattgtcctgaaatgatactgtattaattttaaagattattgtttcaatcaattagaattaaatacaaatgggacattttatatatgttgggaaaagctgagtattgggagaagctgaggcagggctttcatgtctgacataatgtaaaagagtcttggaacatgtccggggtccagggtctaaaaccctttgtggactttggaacaccaagctctgtgctaaagggtggaaggctaccctgacgcaccataatctaagcccagggcataaaacccctcatggcttggatagaatccagggctcgtggctctggaatggaatccttgctccttgctgtcccaggatcgattgtatcttgagttaaaagaacctgctctccattatctcaagtaacagagcaaatgctaaaccatcacagctgtaaatcatatgcttaatgcagagcgcccttttgacccccacattctcaccacctgtttctttgtttgatcaccaataaatagtctgggcttccagagcttggggccttcgcagcctccacactcatgatggccccctggacctgcttttctctctcaaactgtcttttctgattcctttgactccccctgacttcatcacccccatgacctggtgttgggtctgatcacttcaacaatataaatataaatgggatatttgaactactggaagatatatttcagcggagatatacacgatgcctatgcatgtaatatgtagaactgatattttctcaagtctataattctttttgttacatataaagacaacaaacttgctcttcaagaaattattattgcatttttattattgcatttttaaatgtggatgttgctctgctaaccacttagcgagacttgagtgaccattgttaaataattagactttaaaaatacttaaagatgaggggtaaatataagtaatgtatagtattttttaatgaaggaaggaaggtatgatatagaactgcaagaataaaacttaatatttgttttaagttaaacatttatttataaaaactatagtcttgctttcaagaaacttttcaacatggagacctataacttacttcacatatacttaactaaaatatgttaacaggtgattttacctgttacctgatcttttacatttttgctctaccaaaagagctgcagcaaacaacagcatcctaaagactggaaagatagtcaatgtttagggtttttgtgtaaatattcttccaggattcccttgacattactagatggcatttttactgtttttgttttatctatacccaaaatgaggcttacatatctgaatttttaaaaagccgtaatgcatgcagtaattattgctgatattttttcctttaatatgcattaagtatagggttttagtttgtcataattttaaaatgttaaataaacccattgtttttcttttaagtcactgcatgtactagaaacaatatttatactcttaatgaagatggcattttctgaactacctggccatttcctaatgaatgaatactgcagaaaaataagtaaagctcaactattcagttacaaatgttgcacgttacattaatattataagacctttattatttccaaattttcagttgattttattcgactatttttttaagaagaaagctattatgttgatagataaagagaaaactgaagaaagactcatgaaaatataagaagagtgaaaggaggaaaaaatgtaaaaacatcagttttgagagattcagtaagaatatttccattaatttttaggcaattttcttcattgtttttatagaaataaggtatacacttttgatatttatctatttttgttctctagatatttctcagtaaattatttcatgttaaaaatttggaagttagagtatcttgctataaacattttgtatctaaaagcagcagagttatcctcaggagaaataaataaataataactttgatccatgaatttctgttgaccacaataataaaatatttttgggaaaggcctgcctcacccaccattggtgcctgtacaagtcgcttggggtcctggggttcagccaaccctgccagtcaccagtgatgcctgcagataacatctagtggtctgaggacaagcctgctattcccagaactgctgatacccatgcacattatctgggccctctggataagtatgctccaatgaataccaccaccatggtgcctgaggactggcccacctgatgtccctattcttagaaaagcttcaccaatccttcactaaaaaccacagcctaagtcatgaggaagtcatggacaccactgatgctgattaccaacaaataattatatggagactacataacagtacctgctcagaatcaaagccaaaacactgtagtaaacaaacactataaatatatctgtatgaaaaagtgtttctctaagaaggccaatccattaaattgggaaacagtgactatttcaccattggtatcaacataaggacacaggaacatgaaaaagcaaggaaacatgacaactccaaagaaacataatagtgcttcagtaacagatcctaatggaaaggaaatatatgaattacctgaaaaataataatcatattaaggaaactcagtgagttacaaaagaacacagataaaccatacaaagaaatcagaaaaaaattctaagctgaataaaaaattaaataaagatatagatgtaataaaaagcaaccaaatagaaatcctggaaattaagaatttattaaatgaaaatttaaaaatacaatgaagagctacaacaataaactagatcaatcacaaaaaaattctgaacttgaaaagttttttaataacaccatcagacaaaagaaaataaaagaaagatgaagcctgcttatatgacatatatgacatcataaagtgataaaatatttgagtctgggagtttcagagcgaggagataggcaaaaacatggaaagttcatttaacagaataatagtttaaaaacatttcaagtcttacaagtgatattgatatctacatttatgaagctcaaagattcccaaatagatttaacacaaaaagtaatccccaaagcacattatagtcaaatggagaaaagtcaaggacaaagaaaaagttataataacagcaagagaaaagcatgaagtcacatataaccaagcaaaacacaaacaaacaaaactaaactaaatgtcagccaagcatattttacatagcaaagaaaagccgtccttcaaaaatcaagaagaaataaaatttttcccagacaaacaaaaacagaaaagtcatcatcactaaaccagtcctataggaaatgcataagtgagtcctatatctgaaagttaaatgacagtatctacaattatcaaaacacatggaagtgtaaaactcactcatagagcagatacacaaatgagaaatagaaaggagtcaaacattaccactacagaaaaatatcaaaccatgatgataattagaaagtaacaaaagctacacaaaacaatgagaaaacaattaacaaaataatataaataattctcatttatcagtaataatgtagactgtaaacaaatccaatttttcacttaaaaatataaacagaatggataaaaaacaatgcgccaactacatgtcaactataagaaactcacttcactaaaaataaaagactacagacagtctatgcaattggaaaccaaatgtgagcaggcatacctatatttgtgtcagacagaacagactttaagtcaaaaactgtagaaaaaaaagaaaaagattatcatataataataatggaatcaattcaggaatagaatataatactggagcacccagatatacaaaacaaatattgttagatctaaagggagagagagaatctaatactacaatactcagaacttcaacactcttctctcagcattgaacagattaggtatgcaaaatattaatgcagaaacatcagctttaaactgcattttacaacaaatggatctaacagacatttagagaagatttaattcaacagccacagaagacatattcttattagcacacggaacattctctaggatagaccacatattagtccacaaaaaaacataaagataccaaaatcatatcaaataatcttcccagatcacaatggaatgaaactagaaatcaataacaagaaaaactttaaaaactgtagaaatacatagaaattcaacaacatgctcttgaacaaccaatgggttaatgaagaaattaagatgaaaaaccaaaaccaaaacaaataaaaaatgaaaacacagcataccaaaaacctatggcatatagcaaaagcagtgctcaaagggacttttataagaataaatgcctacatcaaaaaggataaattttaaataaacaatctaatgatgtatctcaaaaaacaagaaaagcaagaacaaaacaaaaccaaaattgttagaaggaaagatttaaaaaatatcagagcaaaactaaattagagaataaagaaacatacaaagaatcagtgaaataaatagttgttgttgttgtgtgtgtgtttttaagataaatgaaaccaagaaacttctagctagactaaccaagaaaataagggagaaggcccaagtaaataaaatcagaaataaagagactttaaatcacagatatcccaagggtcaatagaaactgttatgaacagctacaaactaacaaatgggaagaccaaaagagaaaatggacaagttgctggacacataaaacctaccaagattaaatcagggagaattaaaaaaaaattgaacagataaataataaattacaacattgacaacatcttcaaaaaacaaaattatagtactaaatagcttgataaattgtaccaagcttataaaggagagataacatcaatttttttcagactttgccaacaaattgaagatgagagaattctttctgtctcatctatgaggctggcattaccatgataccaaaactagacaaagatacagtaataaaaatgaaaattacaagccaatgaccctcatgaacatagatgccaaaatcctcaacaaaatactagcaagtttagtccaataacacatcaaaaaaaaatacaccatgatcaagtgaggttggttccacgaattcaaggatggttcaacatacacaaatcaacaaacgtaatatatcacattaataaaggacaaaaccacaaagccatatgaccatctcaatagatgtagacaaaacatttgataaacctcaatattctttcatgataaagtttctgggcaaattcagcatagaagatgcatgcctctacatccaaaaagtcatgtatgacaagcccacagctaatattatactgaactgggaaaagctgaacacattttttataataactggaacaagaaaagaaatcccaatttcaccagttgtattaaacatattacttactgaaagtactattcagagcaattagatcagagaaagaaataaaacataacaaaactggaaaaaaggaagtaaaattgtacttctttgcagaaaacaaaatcttatataaagataaacctgaagactctactaaagaaaacacaaactattagaatggatcagtgaatacagtaaagtttcaggatacaaaaccaacatacaaaaatcagtagcatttctatacaccaataagtagctgaaaaagaaactaaaaaagcactttcatttaaagtagttcaaaaatatgcttatgaataaatttaaccaaggaggtgaaagaaatcagagatacctcatgctcatgaactggaagaatatatattgttaaaaaacatattacacaaaacaatcaacagagtaaatgagatttctgtcaaaatactcatgacatttttatcagaaataaaaaaaattatcctataactcatatggaaccacaaaagaccctgtgatcgttaatactgagtgtcaacttgactgaattgaaggatgcaaagtattgttcctgggtgtgtctgagaggttgttgccaaaggagattaaaatagagtcagtgaactgagagaggcagacccaccctcagtctaatcagctgccagcataattagaataaagcaggcagaagaaggtggaaagagcagacatgctgagttttccagccttcatctttcccccatgctggatgtttcctgcccttgtacatcagactccaagttattcaccttttggactcttgaacttataccagtggttttccaggggctctcaggtcttcagacccagattgaaggctccactcatagtatttctaattttgagattttgggactgaggctggcttgcttgatactcagattgtaggtggcctattgtgggacttcaccttgtgatcctgtgagtcaatgctcctcaataaattccccttcatatatacatctatcctattagatctgtccctctagaaaaccctgactaatacagattttggtaccaggcgtgtttctagagaaaccaacttttaaatatggatttctttagttgctttggcatttctggagttggctgctttatcttactagactccaaaatgctaaggactctacttctaaaagtatagagaacactgatagtcctgggcatgaactgtttagagagttgtgcaaaataaatacacatttgatactcctgattcactgctcttgagaggcaaggagtttagtgactctatacatatacctttcaccacatgtggagaaccaacgaatataatgacattggttggctgctctaagttcactggacaaagtgatgaaagaaaatgaaattctcagggtttctaactctcagcttcagaagcacactctgagcctcaaatcttctaagactgttctgagtgggaattttatctcctgtagacaaaaggctgaaattgcagaaaatcagacacaagctcttatgtgagtggctgtcctgcaaggaaaggtgcactctcagccttgccaggtgtctactgttaaagtgagggcactggttggaaaagaatgggaccctgccacttggaattgggacaggtgggaggatgctgatgatgctgggggcgctgagctcctaaattctgaggaggctttttttgccagaggaaaaagcctcctcactcctagtagtggcaacatcccctcccctacccatgctaccaccagcctttacacctttgtctgaggagattaaccctgatttgtctggggcaaatgacctccccagaggcaatttccaggcaagacaatgctgattctcctcagaacccatccccaacacctctgtttgcttctagacctataactaaagtcctgcaggcccctagaggtgaggttcagagtgtgacccatgaggaggtgcactacactccaaaacaactgcttgagttttctaatttatataagcagaaatctggagaacacccataggaatggatattaagggtgtgggataatggtagaaagaacataaagttgcatcaaattgaatttattgatatgggcctaaccagggattctgcatttaatgttccagctaggggagtttaaaaaggtcctaatagtttatatacttggttggctgaaacatggataaaaagatggcccattttgagtgagctggaaatgcctgatctcccttggtttacagtagagggagggatccaaaggcttagggagattggggtgctggagaggattagtcactttagacctactcatcccaactgggatggtccagaagacatacccttcaccaataccttgtgaaacagatttgtgaggggaacacttgcatccctgaagagttctgtgatttctgttctctgcatgccagatctaacagtgggaaccatagtcactcaattggaaaatttaaatgcaatgggaataattggatcccaaagtggcaggagccaactggtgacactcaactgtcaaaggcaaggtgggcacacttaccctaatggacagcagaggcaaagcagcaatcagaatgtagagctctggcatgggctaattaatcacagtgttcctagaagtgaaattgataagaagcctactgcattcttacagaatttgtataagcagaaaaattccaggttgagtggaccaaagactaatttgaattataaaaatagagaatcatggctcctaaatcaattttcaaacttgaaccagtttacaggcccagaaccttaaataaaggggaggctgggtccccttgaggaaggacccaattacactactgaaaagttattctgttaatctttctcccatccttccccaaggagacctctggtcttttaccagggtaactgtgctttggggataggggaatgatcagaccttttgggaactactggacactggctctaagttattgactccaggggacccaaaaggttattgtggtcctccagttaaagtaggggcttatggaggtcaggtaattaatggagttttagctgaggtctgacttacagtgggtccagtgtgttcctggactcatcctgtggtcatttccccagtgccagaatgcataattggcactgacatacttagcagctggcagaatccccacattggttccctggctggtagagtgaggactattatggtgggaaaggccaaatggaatccagtagagctgcctctacctagaaaaatagtaaatcaaaaatagtatcatatctgtggagagattgaagagattagtgccaccatcaaagacttgaaagatgcaggggtggtgattcccgccatatccccattcaactctcctatttggcctgtgcagaagaaagatgaatcttggagaatgacagtggattatagtaagcttaaccaggtagtaactccaattgcagctgctgtagcagtagtttcatttttgatcaaattaacacattttctggtatgcaaccattgatttggcaaatccctttttttttttctattcctgtctataaagcccaccagaagcaattttccttcagctggcaaggccagcaatataccttcactgttgtacctcaggggtatatcaactctctggctttgtgtcataatcttgtttggagtgaccttggtcattcttcccttccacaagatatcacactggtccattacattgatggcattatgctgattgggtccagtaacaataagtagcaaacacactggacttattggtgatacatttgcatgcaatgggatggaaaataaatccgactaaaattcggggaacttctaccttagtaaaatttctggggatccagtggtgtagggcctgttgagatattccttctaaggtgaaagataagttgctgtatttgcccctcgtacaatcaagaaagattcacaatgcctagtgggcctgtttgaattttggaggcaacacatgcctcatttgtgtgtgttattctggcccatttatccagtgacctgaaaggctgccagttttgagttgggtctagaacaggagaaggctctgcaacaggtccaggctgctgtgcaagctgctctgccacttgggccatatgactcagcagatccaatggttcttgaggtgtcaggggcagagagggatgctgtttgtagcctttggcaggcccccataggtgaattacagcagaggcctctgggattttggaacaaggtcctactatcttctgcagataactactctcttcttgagagacagctcttggcctgttactgcgctttggtagaaactgaacatatgaatatgggtcatcaaagtcaccatgtgacctgaactgcctatcattaagtgggtgctttctgtcccatctagccataaagttgggtgtgcacagcagcatttcatcatcaagttgaagtggtatatatgtgatcaggctcaagcaggtcctgacgtcacaaattacatgaagaagtggctcaaatgcccatggtccccactcctaccaccctgccttctctctcccagcctgcactgatggcctcatgggaagttccctatgatcagttgacagaggaaggaaagactagggcctggtttacagatggttctgcaaggtatgcaggcattacctgaaagtgggcagctgcagcactacagcccatttctaggacatccctgaaggtcagtggcaaagagaagtctttccagtggggagaacttcaagcagtgcacctggttgtgcactttgcatggatggagaaatggccagatgtgtgattatatactgatttatgggctgtacccaatggcgtggctggatgcccagggacttagaaaaagcatgattagagaattggtgacaaataaatttggggaagagggatgtggatggacctctctgagtggtcaaaaactgtgaagacatttgtatcccatgtgagtgctcaccaacagtgacctcagcagaggagaattttaataatcaaatggataggatgacttgttctgtggacaccacttagcctctttcccagccacccttgtcattgcccagtgggcccaagaacaaagtggccatgggggcaggggtagaggttactcatggggtcagcaacatggacttccactcaccaaggctgacctggctacagctaccgctgagtgcccaatttgccagcagcagacagcagcactgagccctcaatatggcaccctatcttggggtgatcagccagctacttggcgacaagttgattatattggatctcttctatcacggaaagggcagcagtttgtcctcacctgaatagacagttacttcggatttgggtttgtctattgtgatggttaatactgagtgtcaacttgattggattgaaggatacaaagtattgattgtgggtgtgtctgtgatggtgttgccaaaggagattaacattttagtcagtgggctgggaaagggagacccacccttaacctgggtgggcacaatctaatccgctgccagcacagctagagtataaaagcaagcagcaaaatatgaaaagagagacttggactggcctcccagcctacatctttctcccgtggtggatgctccctgcccttgaacattggactccaagttcttcagttttggaactcagactggctctccttgctcctcagcctgcagatggcctcttgtgggactttgtgatcatgtgagttaatacttagtaaactcatatacatatatatatatatatatatatatatatatatatatatatatatgtatatgtatatatatgtattatatgtattattgtattatatatgtatatatgtattatatatacataaatgtatataggtatgtatatgtatgtataatacatatatgtatatattatatgtattatatatgtattatatgtatatatacatacatatgtatacaatgtatctgtgtgtgtgtgtatatatatatatatatattccactagttctggccctctagagaaccctaactaatacacctatcctgcaagcaatgtttcttccaagactaccatccatggaatcacagaatgctttatcctccatcatggtatttcacatagcattgactctgaccaaagcaattactttatggctaaagaagtgtggcagtgggctcacgctcatggaattcactggtcttaccatgttccctatcatcctgaagcagctggattaatacaagagtggaatacccttttgaaatcaaattacaatgtcaactaggtaacaatactttgcagggctgtggcaaagtactccaggaggctgtgtgtgttctgaatcagtatccaatatatggtactgtttctcccatagccaggattcacaggtccatgaatcaaggggtagaagtcgaagtgacaccaatcaccatcacccctggtgactcagtagcaatttttttgtttcctgttcctgtgacattacgttctgctggcctagaagtcatgttatcagaggaagaaatgctgacaccaggagacacaacaatgacttcattaaacaggaagttaagattgccacctggccactttgggctcctctcacctctaagtcaataggctaagaaaagagttacagtgttggctaggatgactgacctggattatcaagatgaaatcagtctactactcaacaattaggataaggaagagtatcagtggaatacaggagatcccttagggcatctcttagaattaccatgccctgtgattaaggtcaatgggaaattacaacagcccactccaggcaggactacagatgacccagacacttcagaaatgaagggttgggtcactccaccaggtaaaaaccacgatgtgctgaggtgcttgctgaaggcaatgggaatacagaatgggtagaagaaggtggtcatcaataccagctacaaccacgtgaccagttgcagaaatgaggactgtgattgtcatgagtatttcttccttattttgttaaggacatgtttgtgcatgtacacacttgtacaaggaaaatgtcttcattttatttcctttctttttctgatttattgacttcatatcagcatttcagtgttgttaactttatgtaacagcacttaggttaaagattagtgtgcttctggtcgacaaaggatagctgtattatgttaggtgtaattaagaacttattattctctttatttgaagattatgcttgatgtcaggagatgtatatgggttcacgttgacaaggggtggacttgtgatgatgaatactagttgtcaatttgattggattgaagaatacaaagcattgttcctgggtttgtctgtgagggtgttgccaaaggagattaacatttgagtcagtggactgggagaggcagacccaccctcaatctgagtgggcaccatctaataagctgccagcttgattagaataaagcaggtagaggaaggtggaaagagcagatttgctgagttttctggcctttatctttctcctatactggatgcttctgccctcgaacatcagactccaagttattccccttatgcactcttggacttacactagtggtctgccagaggctcacagactgaaagctgccctgttcgattccctacttttgaggttttgagacacagattggcttccttgctcctcagcttgcagatggcctattgtgggacttcactttgtgatcatgtgagtcaatattccttaaactccccttcatatatatatatatatatatatcctgttagttctctccctctagagaaccctaatacagactctaaatagccaaagcaatcctgaacagaaagaacaaagctcaaagtatcacactacttgacttcagaagatactacaaagctatggtaaccaaaacagcatggtattggtataaaaacagaaacatagactgatgaaaaagcatagagaacttggaaataaatttacgtatatacagacaactgatttttaacaaaggcaccaagaacattcattgggagaaagatgcccttttcaataaactgtgctgggaaaacgggaaatccatatgtggaagaattaacatagaacccaactcctcagcttatacaaaaatcagctcaaaatgaattaaaaactagctgaaaaaaattaaactaaaaaggcgcttccatttaaaatagctcaaaaatatgtacatgaataaatttaaccaaggaggtgaaaaaatgggcggggggaataaaacaaatagaaagacacctttgtttgtgaattagaagaatatatatatatattcttcaggagaatagtctaggcaaaggttttatgactaagacatcagattcatagggtaaaagcctccaaatagaaaaataacactatattatactgaaaacctttgcacagcaaaagaaaacattaaacagattaaagaaacaattggttgaatgggagaaaatatttgcaaagtattcttctgacaaagaactaatatccaaaatttacagggaatttaacatctccacagcagaaaaccaaataaccccattaaaaagttggcaaaggatatccgtagagctttctcaatacaaattgtcaatgggtatatttaaaaagtttgacatcacttatcatcagagaaatgcaaatcaaaaccttgatatgatatcatctctccccagttagaatggctggggaattgtcttttatcaaaaagacaaaaataccccaaattaaatgttggtgaagatgtaaagggaactcttagactctgttgctatgagtgttaattatcacagccattacggaaaaacagtactgatatttctcaaaacactaaaaatagaagtaccaaaaattgggcaattctacttctgggtatttatccaaagaaaagaaaaccagtatatcaaagagatatgtgaagctctatttttattgcagcactatttataatatccaaaatagaaaattaacttacatgactggcaatcgatgaagggattacaaaaacgtggtgtaaacatacacaatggaatactattcagctttaagaaagatagaaatcctactacctaagactatctaagacaatatggatgaacctggagggcattctgttaagtaaaataaacaaagcataaaaagataaatacattatctcacttatatatagaatctaaaaaagttgaactcattgtagcagagagtatgatggtgattattagaagttgagggtgcaagcaaaggctggggaaatgctgaccaaaagtcataaaatttcaatgaaacaggatgaatacattcaagagacctattgtaactaacaatgacaatagttaatacgttgtacaattgaaaatagctaaaagagtagattttatgtgttctcaccacaaaaaagacaagtagtgaagtagtgcatatgtaattagctttaggtcatttgacaatgtatacatatatttaaatgtcatgctgcacaacacaaatatataatatttgtcaattaaaaataaattttaaaaattttacgtattttagacattcagaaaggtatgagagtctcaaatccttttagattcaatttttttgtctaataagacttgttcaaatgtactatttcaaatgtcctaagaatgaacatggaccccgactcctcaccttgtacaaaaatcagctcaaaatgagttaaaaactagctgaaaaattaaactaaaaaagcgcatccatttaaaatggctcaaaaatatgtaatgaataactttaatcaaggaggtgaaaaagtggcgggggaataaaacaaatggaaagacacctatgttggtgaattagaagaatatacatgtatgcttcaggacaatggtctaggcaaatggggttttatgactaagacatcagattcacagggtaaaagccccaaaatattaattcatatacaactacttcaattatagccgtgtccatctattacccccatgttatttacttaatattttcttttaaatttatttatttattcagagacagaatctcactctgtcatccaggctggaatgcagtggcgtgaccttggctcaccgcatcctccaactcctgggtttaagcgattctcatgcctcaaactcccaagtacctggaattacaggtatatgccatcacacccagctaacttttgtattttttagcagagattgggtttccccatattgcccaggctggtttcgaactcctgacctcaagtgatccacccacctcggcttcccaaagtgctgggattacaggagtgagctaccggtgcctgccctcttttaactttaatcactctttcttagctttatttgaataataatacccatttatccttgagttttaatgctcattattttttaatacatttcttctaaaatacttttaatgtagaaatacattttatagtagtgatattttctacactggtatattgaggaaaccagttttggtgtaaacaattaatttactctactgggcataagataatttcaaagatgaatataaaacatgaaagctcttttgtcagcagtatactatatataggaagaaagaggtatacataagtgtgtatatatatatgaaaaaaatgtatatatacacatacactaaaatatgcattaaagaaaaccttgtataggtggcaaaactgaaatttaaagtactgcaattgtttcagtagcattgcttatacagtctttaacaaaatccttaatagagtggaaataaaggggatactctttatgaatacagtatgcgtgagtgtctgtgtgtgtgtatgtgtgtgcacgtgcatatgtgtgtatttatatatgtacatgtggacacatgcattgtatagattataagctttaatcctaccttagcatggataatggagagttaactgtaaaatgttttaattttatctgaataggaaaactcaaagacaatccccacactgctgaatgctaaatgttcttctatgagtttaaggtcaaagacatgaaatgtagattaggcacttagatttctacctgaattttcagaagcccttttaagaaggcagttcacattaaatgcatggttataaatcccatttaaaataactcacttcatgttttattttaggtctagaatttcttttacttttatcaataaaattatgccccttccaacaacttaaagcgataatttgtggtagtttatgatggcatttgaaccacatcttatctttactcatttgaacttagatatgcattggacaaggatggataatttgccatattgctcacatgaaaatggagagaatttcttaacttgaagaattgttttaagattagctttgtgcactggaagagtgtgtgagattaaactaaaaatgggaatacatttcaaaatagtataaacattcttagtttacaaataaaaatatataaatcaacacaaccaggcagtgtctgctcagaaaatacttccacaaattctgggaataaccttcatccccttctttccctcacatcctattccttttgtactcaatcagtcatacaatcctgtggtttctataaccaatatgtctctcaaattctgctttactcccttacaattttattaatatacataaccctgattttatcactccattgctaaaaatcttttaaggatgctattgaaggacacactctttactatcatgtctgcctatctttgtatctgcatcacccacatctagctcacatggatcctatgtctgtgtagacatactgaactacttactcttctctaaatgtgtcctgctgttgcatatgacctttgtatttttatgcacagtcctcttaatctacaataatctttttctaactggtctgcctcaattacacatgattaaacaaaccagctcaaaatctgcccactctgttacatcaacactggctctcccaaccttaatcaggcagtgttctgtcctctttttcacggagcctgaagcacacatcaattatcaaatcatctctctctctctctgtctcactctgcccttctctcttttcttcccttccttcccctttttcctaagaatagcggacaccttgagggcaaggggcttttgtatttcttaatttaaccaatcaaagcatgatttttcaaaattatagatacttgtaactgcatccaatctaggatgttagttttttaaatttgtgtagataaaacatgtctgtttttttttcctccagcgtactttcaaaccctattaaagcaaaggcagtcacctgttacttcgacacctgtttcctttttagtacctaacagtatctcacttgtcagattgttgaaatgtataaagaaaacaacataaatcctgtctcatggtaagtatacaagaaattttagccattttaatatttttgaaataattatttaaggttttacttgtgatcataataacacatgcatttttaaacacagaatacaattagaaaatacgagaggcaattgaactaaaggggttatctgaaagctgtgtattcctctaattgtatctataagaaaattaagacagagaagtaaatgatcctacagttcagtgttataaaagagaaagaaattgagtccattttactgactaatcttttcattttataaactcccacacattcaaaacatgcttactgtttgattttagttagtgacgtaattttgatgctgacatgtaacccatttttattgtacgtgtagaacttccctaccaccaacatcaccaccattaccattctagaatatggctccatgagggcaacaataatgtgaactttctttactattctgtaaagagctccttggcaattagtatgtgttcactaaatgtggtagaagcaatatctgttttaatttaggtgttctggaaaagagttcctcaagtgcatgtttaaattggcttgttagaatttattatataactttctaatagcttgactttgacataattttctctcagaatattagctatcattttcaaattccagaactcattgattgcatattcttctaaagttaatcacatttcataagatacatttccttgaatctgtaacttgaacagatatcttcaaagcaacaaacttgtcttagataaaactcttaagaaactacactgacaccagactttatatactcttacacaaggtacgttgaataatcttggaatagaaactatgctttagagatacttttttttcatttcctaaaaaaaaacctgtatgaaaattagctattttctattcccctacccctctaaatgaccccattttctttctttcttttctcagccataattatggtatggatatctatgcattaggatattgagagaaaaagagagagtatgagttgggatccacctcctcagaaaacttctatcaaagagccttcagttccatattcaagtagggatgacatttttctgctcacagtgtccagtgaaaacttcaagttcatcactttccatattaagatgaaatatttatatttgcagtgtcagcacctgacatagggccccagacatcacagatactcaatagttatttcttcacctgaatattagaatgcattttctaaccctagcaccaatttcctaatttattttacaattaagtaatcctctcaatcttataattatattagttttagtcattatatttggaaccagctggattcttctcttgagcatgttaaaatgtttaagattagtgatgttcatatatggatgcatgattaaatattgtataatatttaataatctagttatttggttcataaacagcaaagtgaatgcaattagcaatgtatgctgcttacttgattaaaaattattcctcatttaagctagtaataactgccttcattgattgagcaatttagtgtgtgccaggcaagtatatttatgaattatttgaatccctactataatatttttattaacctatttatattggtgatgaatttgagcattaaattaattagacaatatgcatgatattaaccccctgatttttatcctaaagttcatatttgattaatgctcttttaccaagttgatacagtgagtatctacatctatcactggctgaaatataccagtatgctaaatcagtaagatcactttctatttcacttcaaaatcaaaaccttaggttttccaggtctatgttacattccctgtaggaacacactcacacacaaaccacatgtacacactataaacataaacacaaataatctctctagactcatctcttctcatttatgccctcattcattcatgtcaccagaattagcttccttgcccttcttcaaaattatttttcttaagccatcccctcaagcatttatcctttgagttacaatccaattgcattctttattttaaaatacacaagttattaatgactgtagtcatcttgttgtgctatcaaacagtcagtcttattcattctttttaatttttggcacccattaaacatccttacttcccatccccaaaccccaatacccttcacagcctctggtaactatccttctgctttctatgttaatgaggtcaattgttttgatttttagatcccacaaataaatgagaacatgtgatatttgtcattctgtgcctggcttattgcaacataatgagctccagttctatccatgttgttgcaaatgattggatctcatttttatggctaaatagtactccattgtgtatatgtatcgtatttttctgatttattcatctgttgatggacacttaggttgcttccaaatcttagctattgtaaacagtgctacaacaaacacaagagtccaggtatctcattgatatgctgatttcctttattttgagtatatacccagcagtgggattgctggataatatagtagctcaatttttagttaattgaggaacctctcaactattctccctagtgattgtattaatttacattcccaccaacaatgcacaatgtccccatttctccaatccttgtcatttgttattgactgttcaatttttatttaattgaggaacctctaaactgttctccatagtgattttactaatttacattcccaccaacaacgtacaatgtccccatttacccacatccttatcatcatttgttattgcctgtttttagatgtaagccattttaactgggatgagatgatatctcattgtagctttgattagcatttctttgatgaccattgatgctaagcatctttttatatgcctgtctgccacttttatgtttccttttgagaaatgtctattcaaatcttttgtatgttttttgattggattattagatttttttcctctaaatttgtttgagcttcttatatattatcattattaatcccttgtcagagaggtagtttgcaaatattttctcccattttgtgggttgtctcttcactttgttgattatatcctttgctgtgcaaaagctttttaatctggtgtgattccatttgttcacgtttgctttggttttcttgtggggtactgctccagaaatctttgcccagaccagtgtcctgagacttcccccagtgttttcatgcagttgtcagatagtttgaggtcttagattttagcctttaatccactttaatttttgtatatggtgagagaaagaagtctagtttcattcttttgcatatggatatcaagtttttccagcaccatttattgaagagactgtcatttccccagtgtatgttcttgccagctttgtcaaaaatgagttcactgtaggtatctggatttgtgtttgagttctctgttctgttccactggtctatgtgtctgtttttatgccagtaccatgctgttttggttactatagatctgtagtataatttgaagtaagttaatgtgattcttccagttttgttcttttttgcgtagaatagctttggctattctgagttttctttacttccatattcattttaggatcttattttctatttctataaagaatatcattggtattttcatagggattgcattgaatctgtagattgttttggatactatggacattgtaacgatattgattcttccaatctatgcaaatggaatatttttctattttttggtgtcctctttatttcatcagtgttttatggttttcattatagagctcttcttttgttatgttaattcctagttatttaattttatgtgtgactattgtgaacaggatttcctttttatttctttttcacattttcactgttggcatatagaaatgctactgatttttgtacaatgattttgtatcctgcaactttactgaatttatccgttctaatagttttcttgtgtagtctttagttttttccaaatataagatcatattatcagcaaataagaataatttaacttatgcctttccaatttggatgttctttaaatatttatcttgtctgattgttctacctaggacttccagtactatgttgaataacagtggttagagtggacatccttgtcatgctccagaacttagaggaaaagctttcagtttttcccctttcagtataatactagttttgggtctgtcgtatatggcttttattatgttaaggtacgttttcttctatatccagctttctgagaatttttatcataaagggacattcttcagcatcaactgaaatggtcatatagtttttaccctttattctgttgatataatgtttcatgttttattagcatatgttcagccatcctcgcattccacagataaatctcacttggtcatgattaatgatctttctaattttgaattttctaatgtttgaattttgttgaattttgtttgctactattttattgaggatttttgcataaatattaatcagatatattgacctgtcattttatttctttttggggagggtgttttaatttttattaagttctcaaaaccactaatacaagtctccaacttatctcttcaaatatgtttttttattcattgtttaagtccaatatatcagattttaaatacttcttcattaaaattattttattatgggtagggtcataagacagctcatacaatggtcacagttctcttgctgtctaaacatgtccgtgtttggcatattgagtaccttttgagggccagccaggaaacctgtaacctgattacctcttataatggtttataagattgttatttctgtggccagtatgtttcattatatcctccaaatggcaagaataggatgaggaggacctatctgtgtggtaagggaggaaaagagagtctgggtccaagatagtcgaataggagggtgaatgctaatgcataggcagaattgctctcacaggccctggaccttgtgcctccctctctccctcctcttcctttctcagaaggacatgtggtgacatcagaaatatagacttcacctaccttctgtattatttatctgtagctacataacaatcatgtgtctttctctggctttggtatcagggtaacactggcctcatagaatgaatttggaagtatttccttctctatttttgggaattgtttaagtaggattggtagtagttctttacatgtttggtagaattcagaagtgaaggcatcaggtcccgggcttttctttgcagggaaactttttattacagctttgaccttgttacttgttattggcctgttcaggttttagatttcttcctgattcaattttagtaggttgtatgtatttagtaacatttattctagatttttcaatttattggcatatagttgctgatattagccactaatgatactttgaatttctgcagtatcagttgtaatgtttcctttttcatttctcattttaatatttggaccttcccttgttttttcttaatctggctaaacgtttgtcaattttgtttaaattttcagaaaactttttgtttcattgatcttttgtattttttatttcatctatttctgctctgatctttatttttttcttctaatgtttttggttttgctttgctgttgcttttctagttatatagtgaccttgtctcttattatagtttttgttttgaaatctattttttctgatataagtatagtgattcctgctttttattggttttcattggcattgaatacattttttcatattttattttcagtctatgtgtgtccttataggtgaagtgtgtttcttgtaggctacagatcaattgtttatataactattcagatagtctatgtttattgatcggagagtctatttacattcaatgttattattgataagtagggactctggtcattttgttattggttttctgattgttttgtggtcttctcttcctcctttcttttcttcctgtcttcctctaatgaaggtgatttttctctggtgatataattcaggtttttgctttttattttttgtgtatccattgtaagtttcttggtttgtggttactataaggcttgcaaatactatcttataagccataattttaacctgatataaatactatttgcataaacaagcaaaaacaaaactaataaaaactctacacctaaattttaagaagttaaaaatgctttttaacttctcattgtttctatttattgtactgagtgcgtcttgaaaagttgttgcggtaattatttttcctgacttatcatttagtctttttacttaggataagagttgtttacacaccatagttacaatgttgtaatagtctgtgtttttctgtgtacttactattagctgtgagtcttgtaccttcaggactcattattgctcattaatgtccctttctttctaattgagtattccctttagcatttcttgtaggacaagtctggtattgatgaaatctagcaggtttgtttgtctggggaagtatttctctttcatgtttgaagaatatttttgccaggtatacgattataggttaaaagatttttccttcagcattttaaatgtgtcatgccattctttcctggcctctaaggtttccactgaaaagactgctgtcaaatgtattgaagccccattatctgttatttgttttctcttgctgcttttaggatcctttcttaatccttgacatttgggagtttgattattaaatgcttgaggtagtcttctttgggccaaatttgcttggtggtctataatcttcttgtacttggatattgatatctttctctaggtttgggattaaaacttatttctacccctagtttacattttctatttttctgcctaagtgctcttaatgataacttgacctctgtaatatctccagtgtaatttctattaatcagtgactgctcaaatttaaatagcaactctcacctacacctctccctatcatacctacatgctatattttctctaggcactttttaaatcatttaacacattttgtctctcttctttgtaatatattccctctctctagattgctagcttgacagggataagaattttctctctttagtctaacactatatctatccctaaggtatagattatagtctggttcatagtaggtactcaattaatggttgtggaatataccaatgaatgaaataataatgcatgaaaaaatgcctgaaatccataataaatttgacagaaacatttatcagcacagaattgattatagctataatctacataattaactaaaattatgtccgatagtcacacaggcttaaacttaaattcatccttgctcacttatttactatgtgatgggtgtaattagcactttcttcaaaccttgcatcttttaatgtaaaatgttaataatttcttcatagccttattttcggtattgaataagaagacatataccagttaataacactttcttccattttcttctctatatgctgtaggataagataaacatacatgaaggtaaagtgaaagtgtaatttatctttcaaaccagaactcatttaagagcaaaaaagggtaatatttataattatattgggacaacagatgtacatcaggtctgtcacaagtaaaccagaacgtatggttagcctacctaataagcacacacaaattcagatattgaaaagaattaaaagcataccagtgtgctggcatagtgggttggcacttagtatcatttgcatcattttcagaggttgggtatctaaaaacatttctcaagacgcccttgcacaagttttcttagtattaattaggtttttccagtgtaatgcttaatatgagattcagagggtataagcataggaaagggcatacttcctttgctttagctgttgctgcagacaagtacagtgatgttgagattttctataacagagactaatgtctagccactaccttagtggttgttgagagacagttttgatagtggtgtcttccttgtgcctagataatagccacagtggtattttattaaagtccgaaaaagacagcagctcactggcaagccagttcttcatggagtgattctgaatattaggccaaaagaccttcaagtgatttgtaagcatttgcattcccatattaaatgcttgctgctagggatggtactgtttcctgcagctgagagttaacgaacatacaagatatactaacagagcctcctaattcacagcactgcttctccacttagtgctaatatgatcttttcataagtgagtgagtagtcttggccagtctgcttaaacagcatactaacaaattttgaaatacatcttcattttagtcaagaatatagaagaactatcactctttctaattggttgcttctctggaagttttatcttaaatatgtctgttatggatcaatatttctgggataagttttcttggattgcatggaaaagccacacatgttcactaacactcttatctaatctcagttcttctgatagtgaaaatacataaccacaaattaagtcaagtttttaacaattaaggaatgtgctgtgctgtctagataaaactatgctcaccttttatgattaatctttaattagtagttgacttaggttaacatctgctggcttcctcttttattaataagcaaagatacagtccgtgtcttatagattttctgggatattctggtgtaagtatctatgataagtacaagtttttgacttcattcacaagtttttgggttggcataatgcacatgagttaaggcattcttgtaaaagagtataaatgcattagtatttatttttctgaagcttcctagaaagcattattattaatgatagtacaagatgatcatgtatatacaaagaccaatgcaatcttttcagatgtttgtgttgagacaattgttgcatctgctgataacaacaacaaagtcttcaggagactgtttataatttttttagaatgttataactttgaatgtgaaatgatgagtacctccttttaataattcaatattagagtaaaatattttagccttaggtgaagctgagtcaatgagaacttacatggagtatgtttagacctcacagtcagaagaacaaagctgtttagagccaatttgtttgcttgaaattgaatgaaatccaattatgcctacactgtgataataaatatgtaaaattcatgaatgcaaatgggtaacagttggaagggaacagaagtgttactgtagttgatttgatagtttagtaggatttggaatattttaattttactttcaggttattggtatgataaacacatagaaatataatgaattaaatttctgtctagcattttatcccacaatttatcatggtgatatctgaatctgatacacagtctggtcaagtatcctggtgatattgaataggctggttcaattatgcttaaattagaaatggagaagtagagtcccaaggacattgggacttatgtcgaccaagtgactcccagactgtatccagtaatggcaataaaggaatgaatctaaccctgtcaacattcaaactccttcgggttaaccaaacaaatcaagatgaggtatttaagaatataattttcttacagtaaagactacataaataaataaaacatcactactttacccagcatataaacacagataagaaaatggcacaaactgggaaataatataaaagagaaaataaggacagtaaaattatattatattgcctccggcttacacaaactattttaaggatgcaatgacctctttcacataaaattttagaaaattaaaatcagaatattttctctgaaagaagttttcagaaagtttgtgtgttaaatagctttacgccttcaggactacatatttcacatgaaacactaagaaagcagaaaacaaagtaaaagacccctagggatttcaaatctcacagatttactttaaaatgttttttgaggaaatgagtttcctacaaagggacattcaggctatcaaaatatctactgaaaagaaagtgaatgaaatattcaatgacttttctcaaaataacaaaagtaataaagaaaaccattagcaacagtaacctattttaaaggcaaaagtcctttcagacttagtgctttatttttcctctctatatttcagtggcattatctgccaacaaataactgaactctatttatcagggtcaacacatctgctaataaataccaacattagctttcaagccttgcatttccaagtttaatactgtatttaaatggtaccacaaagtttaactattcctttattccattttgaaaatataaataaactatatgtatcactgccattacagcttatttaagcagtcttctggtgaaaatatattctatacataatgagttcaataatccttcattaatagtttaaaatgtcaaaaatgaaaattaaattaaaattatttgcataaaattgtaaactgtccttcagtgtgggaaatatattttaaagtatttattgtatccctagaaaaagaatctttcttaacgttttgcaatcttgaatattgggaaatcttttaaaaattatttggcagctaaattttagactgtctcttcctttaccttatactactaataaaataagttactatgatacatttaatgtatattattttgacatatttaaaaatacaagtcaaacattatcagaagataattggctcatagataaggaataacaaggacgatatataaaagtcaaatattttataaaatttttatcagtgagttttatcagtgagtttaaaactcactgataattcagtgaatatccacatatacattgagtgctatgtatatttcaaacactgtgaaacacaaatgagagatacagaaataaagttttgcctattagaaaaatagatttttaaaagatagcgctacattgatgagttcatagagaatttaggatgtctcaaacaaaattaatttataaaataatataatatttttaatgggatttggtcatattatcaaacattaaaattatgtcctcattgatgccacagtctctaaggaattcttcctgtgaagttaattacaagttttcctaagaaaacaataatatatgaatatattattctgtaatttgctcttttaacttaacaatatatgttgctcaacctaaatatttacatttgatcccagagtattgacttaccagaatttaatatttcttttacctattttgtatttcaaataaagtataataaaaatccttttagcacagtatttctatgtgattaaacttcaatttctattggatcaaggcctagaaaataagttgctcattcaatgcgtatatatactttaatgtttaaagatgctgctaaacgaatttcacaaagttttgagtgaagtccaattttattggaaaggttatgattgcaacactgaatatcatcaatctcagatttctgtcaacttgattgtttaaatagatttcattatttcaatcatcatgtccacgatggcttgtgaagtggagctattttcattgatagtcatttgcattttctcttcattttattaacatatatgtttttatgtaaagcagcaatattaacttcttatctgttaaatatctcatatagcaggttgagccatgtgtatttgtcaattagtgaaaatttttgttctacatgaatgacattagagtatggttcaaccattattttatctcagtctattatttgttatttgaattgcttatcacttctttaaaaactaaaattttaatttaatgtaatttgtactgtacctatattcctttatgttatacttaaatattatagttttatagctttgtacatagcataaaatgggactctcctttctttccaagtaatagctgcttttagtatttcaaaattaattcattattaataaatttccacttatttgtaggactggaaaaatgattccaaactaaaattcctacagcctttcagagttaatgtaacagtttaattattgtttaattatgtgtaatgcattgaactagacattctttttgtctatgactcctaaataacgtgaaatgtaaaatgatcaaaatgaatttaaattttacaaaatgatactataaaaacatattacattaattaaaaatgaaaaattttgcctaaaggtaaaatgctatttgcaatgggaaaatgttattgatggctataatttcttatgagattgacatattaataatttaatgaaccatgtgatgacttgaagttctcagcctttttggcttctgaaacctttgctgtctacaggatattgtattatcacttgtcttcatttttctttaaggcatcatgaagactatctccatactttcccaaataggctccatgttttattttttttaattttttttttaatttttctttttttttttcattcccccactttattgaaacaattttcactcaacagatgacaggctgcagcttgaggaagagctgatcaccttttaactgaaggtgatgattatgactaatactttttaagccctttcatgcaacatacatcttcttgaatttctcacaacactacaaggtaggcactttttttttccctttttttaattattattattatactttaagttttagggtacatgtgcacaatgtgcaggttagttacataggtatacatgtgccatgctggtgtgctgcacccattaactcctcatttagcattaggtatatctcctaaagctatccctcccccctccccccaccccacaacagtccccagagtgtgatgttccccttcctgtgtccatgtgttctcattgtttaattcccacctatgagtgagaatatgtggtgtttggttttttgttcttgcgatagtttactgagaacaatgatttccaatttcatctatgtacctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtatctttatagcagcatgatttatagtcctttgggtatatatccagtaatgggatggcagggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttgtttggctgcataaatgtcttcttttgagaagtgcctgtttatatccttcgcccactttttgatggggttgtttgttttttttcttgtaaatttgttggagttcattgtagattctggatattagccctttgtcagatgagtaggttgcgaaaattttctcccattttgtgggttgcctgttcactctgagggtagtttcttttgctgtgcagaagctctttagtttaattagatctcatttgtcaatgttggcttttgttgccattgcttttggtgttttagtcatgaagtccttgtccatgcctatgtcctgaatggtattgcctaggttttcttttagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgaggactctgttctgttccattgatctatatctctgttttagtaccagtaccatgctgttttggttactgtagccttgtagtatagtttgaagtcaggtagtgtgatgcctccagctttgttcttttggcttaggattgacttggcaatgcggactgtttggttccatatgaactttaaagttgttttttccaattctgtgaagaaagtcattggtagcttgatggggatggcattgaatctataaattaccttgggcagtatggccattttcacgatattcattcttcctacccatgagcatggaatgttcttccatttgtttgtcctcttttatttccttgagcagtggtttgtagttctccttgaagaggtccttcatgtcccttgtaaggtggattcctaggtattttattctctttgaagcaattgtgaatgggagttcactcatgatttggctctctgtttgtctcttattggtgtataagaatgcttgtggtttttgtacattgattttgtatcctgagactttgctgaagttgcttatcagctttaggagattttgggctgagacaatggggttttctagatatacaatcatgtcatgtgcaaacagggacaatttgacttcctcttttcctaattgaataccctttatttccttctcctgactgattgccctggccagaacttccaacactatgttgaataggagtggtgagagagggcatccctgtcttgtgccagttttcaaagggaatccttccagtttgtgcccattcagtatgatattggctgtgggtctgtcatagacagctcttactattttgagatacgtcccatcaatacctaatttattgagagtttttagcatgaagcattgttgaattttgtcaaaggccttttctgcatctattgagaggaagatctaccaagcaaatggaaaacaaaaaaaggcaggatttgcaatcctagtctctgataaaacagactttaaaccaaaaaagatcaaaagagacaaagaaggccattacataatggtaaaggaatcaattcaacaagaagagctaactatcctaaatatatatgcacccaatacaggagcacccagattcataaagcaagtcctgagtgacctacaaagagacttagactaacacacattaataatgggagactttaacaccccactgtcaacattagacagatcaacaagacagaaagttaacaaggacacccaggaattgaactcagctcggcaccaagtggacctaatagacatctacagaactctccaccccaaatcaacagaatatagattttttcagcaccacaccacacctattccaaaactgaccacatacttggaagtaaagctctcctcagtaaatgtaaaagaacagaaattataacaaactgtctctcagaccgcagtgcaatcaaactagaactcaggattaagaaactcactcaaaaccgctcaactacatggaagctgaacaacctgctcctgaatgactactgggtacataacgaaatgaaggcagaaataaagatgttctttgaaaccaacgagaacaaagacacaacataccagaatctctgggacacattcaaagcagtgagtagagggaaatttatagcactaaatgcccacaagagaaagcagaaaagatccaaaattgacaccctaacgtcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttctgaaaggatcaacaaaattgatagaccgctggcaagactaataaagaaaaaaagagagaaaaatcaaatagacgcaataaaaaatgataaaggggatatcaccaccaatcccacagaaatacaaactaccatcagagattactacaaacacctctacgcaaataaactagaaaatctagaagaaatggataaattccttgacacatacactctcccaagactaaaccaggaagaagttgaatctctgaattgaccaataacaggagctgaaattgtggcaataatcaataccttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgacgcaaaaaatcctcaataaaatactggcaaaccgaatccagcagcacatcaaaaagcttatccaccatgatcaagtgggcttcatccctgggatgcaaggctggttcaatatacgcaaatcactaagtgtactccagcatataaacagaacccaagacaaaaaccacatgattatctcaataggctccatgttttaaagcaatattacttggaagtaaaatgttcccaagcacaaacaaaagcacaaggcctaaatcagatggctatccaatgattcaaaatatgcttctgcgtttcattattcaaattaaaacaatacaaaatacaaaatgtaaacattattgtagagaacttctagaagcataaaattaagtccagggaacacttcgtaggatgctgatggatgcacctctctctgtttccctttaacaaagggagaggagtacagctgtgtgaattaaaacaaaacaaaacaaaacaaaacagtaaaaacagaatacatgcatttcacaccagtaaaatgtagatacttccctaggtgctctacagccgcgattctctaataaaccctgtgtatgaacattaatcatgaccatttaccaaggatgaaattgaagctcagagaaattttaagaatttccctgaaccacacaattattaggcatgagacttagttttcatacctaagtgtgtctctttcaaagcccctgtctttctgctttcaaccctgaagcaataactttcagctgagtgtctgctatttaactggttcctgctcactacatatggcttcatttcactgctcttatatttgctgaaaaatgttagaaaaggcaaacaacttattgacaaaatgagcctatggcagtcaatttaattccaaagctctttcaaaaccctgccagtaatcttagctgctgtttcttgtatacatatggctccctattttcaaaaaatatattaaaaacatattttgtcataattaacagcaatgtgattatgcagatggcttaagcttacacaggcatacaacaaaatgacataaatacagaaacaaaaaaaaattgagagatcagactggaatgtttaattccctgaattttaacctagattgaattcagtggtactttcagcagaactccctcctgctttacacctgaaagcagatggaggcagattgcattatgagttcagtcctttcaaattacaatagtttatgatgctcatctgcattttaatcagatacaaatgatttattcctgaaatgcatcaagaaggcctattttcagcacttggaaatgcatcagaaagtttatggccaatcaagtaaaatatggtgcatattttaactttatatctatttcttgggagtatatgttacatggacagaggtgtcagctgttttattagtagctgtgcataatcctttcaaaatagggatggagaggtggtttcatactcaaaaattatttttattagaattaactcattttaaaaggagttgggttttgtcattcaatttaataatcatttacctaaaatgttagtcttaataacaaagtagttagcaaatagtaacttccatctactatagcctccttaagatcaaataggacttgatcagcatacatccagtccctggaaattaagtagggcatcagatctatgatattaatagaataagtgaggagattttaatgttactatttagaggatactatttattcacttttaaaatttatggcaattatgaaattaaatcattttcaatgtaatacctctgccatattgaataaaatacattttagttttccacctagtatttgaatgattacaaattttgcaatctgctttgttattttttaattgatttttacatactaactaaaagggatataaaatgtaataaattactaaggtcccaaaacaaatatcaaaattaaagagaatacttaagaactcattatgttgaaaagtatgtttttatgaagatgatatatttaaactaatacacataaacttgtaatatttatacctttagttcaatacattttaagcaatagatatacaaatgttccagaatttaaatcatcccaggttattaatatattaccttttgcaaatttaattatataaaagcattaattattcaaatgaaattcaaagaatcatctcattttttctggtgatccaaattgtttacttatctatagtttctcaaatggtaaattactatattacctttttacctgtttagatgtttactgatctattgttaaaaaccagcaaagacaaaatgttgtcagcaaattaatagtatcttatttctggaaaaaattatgaagtctttgttatttaagtctttcattaaataagtgtacatattttaaaaatgaaattgtattcatcaatttatagtagcatggaaaagacatggcagaaattcagttcttaaggaatcttaagttaggaagcaaattaataccatttcattttgtaactaaaggtctaatatttattttatcagaagttgattgaaccaaatcaagtatggacttggctctttgtagaaaatacaacatagaagatatcattagtgtgatggaagcagctgtgatagaacataatccatatattttgattagaagacatgaatttctttctactttatctacttactgtgtgattttgaacacgtcatttggccccattgagactcagtactagaatgagtattatctttttcttcaaaaacggctgtgaaaatttacttatataatttatataaaagtgttatcaaactgtataattggtaaaaacgttaagtttcacattttttaaaaaaaagtatcatcaaattccaaagtctctgtacatcttccagaatccacttcctataggtttctaatcagatttgtcaatgcgaggcacatgcccaattttaggcggctgaaagggatataccattaaatctgtagggagaggcagctttagctaggtgtatgtgcagaggtgaaattcccagctagtgaaccactctagtgagtcactggcctctattctttagactggggtcttttgcttatgatacctccaagtttaactaatctctccatggtttttgcttctctaaattttccaattattgtgtagtctctttttacctgatattaaatattttcacctaaatatgtattgaatgacttctgttctcctagccaaacccttaatgatatatcaacatttacctttattgtctatatcaactgttggattgaaaagttgcatagcagtcatttgtgaacacaaagtaatcagtagtatcaagaggtttttggttatataatatcatacttaatattggcactgtttataaacttttcactttgaagctatcttttgccttgtcttcctttaattctcaacatttgtacttttttttttctttctagattgtgtttctctggtttccttgattttttataggaagttgtccatttcaccaaagttgtataacttactgacatacaattgttcataatatttatttgtaaaataatctcatgtatttcaggaagttcagagcaatgtcccttcttttatttatgattctaggaatttaagtattttttttttggtcaaggtagctaaatgttgattttgttaattgtttcaaagaatcagcttttggtttcattgattttctctactgtttttccattgtctatttcattaatttctgctctaattttcaatattttctactctctgctagctttaggattaatttgctctttttttccaatgccaagggttgaagtttaggttgtggatttgagatccttctttttcaatatatgcatctgcagctataaatttccctctaagcactgctgtagcttcattccataaattttggtatgatgtgacttcatttttattcatttcaaaacattttctaattcccctggtgatttcttctttgaatcattccttacttagcatgatgtttaacttccatatacttgtaagtttcctatattgatttctaatttcattttatgattattggaaaatgcactttttattatttctattcttttaaatagactgagatttttttcggctgcatatttgtctaccctagtgttgggtgaggtactccacagatttccattaaatgtagttggtagggatttagagtctctgttctacgtcatgcttctccaggcaaaatctctgaaccatacctctggtggtgggagtagagacaatgtcatgcttttctcatggtgacacctccactttaggaactgaaaatctgatagataacgaaggcagcagccccaagattcctcggcttgcttctcctagcatggaacctctgccacaaaagccaggacaatggcggttagggttccagtatactccgcagtactgtgtccaaggtagatcgtctgcctcttaagtagggagtgagaagaacaacggtgcttccactattgaactgttttcaccaggaactcagcttcagcgatatgtagctaggagtagtgtgagaattgctgatatcttaccctcctgaaagaatacttctctgactgggaacttgagggaaagggaactccatatagtgtctgtatcagtctggagtgcaattttcatttcactaagctgggaggagttgtttatcaattttagtatatttaaaaaaataagtgtttcttcatttactgtatgttctcagggccattgacttgaaatggtggttattttataatactcaccagtttcgctgggagtgaatccctagagctcctcaggctatcatgctaaaagtggaattctcctttcttgacttttaaaatccacttgttacaaaatacattatgtttttatattaggtaaattctaagaaaaactgctgagaagaacagtacattcccattattttgctaccgttcaaggagagaaattatttcgccaattaaattcaatggggtttatttgagcaattaaaagcaaaatggaacaaaataaaaatgattcatgaagcagaccactctcagatccaaatcaggttcagagaactccagctaactatgtgacctgacagcatttatagaaaacataactgagacatagagacaactaaattggttacaacaaaattggttatttggttacagagcttcctgcaattacctaaagctcagctactgtgattaaactttatattggtttggtctgttgggtccagtgcaggagcccagtctaaatctgtggcctcctgtaaattttatttaactctactgtctaactttgttctacacacacggtcctcagagccccgtattatggggtcatcattaaggttatttccttatgatttagtacattctattccagtgcttctcaaagattaggtatgcacaacaaactttaagatcttgttaaaataggttctaatttagggagtcatgctgggcctaagattgttatatttttactaatctccatgtgacactgatgctgctggtctgtggattactctttaagtagcaaggtttggttcatccttaaaaacctaaataaccgttcttttaaaactgatcatctattggccaggttcggtggctcatgcctgtaatcccagcactttgggaggataacctgaggtcaggagttcgagaccagcctggccaacatgctgaaacaccatctctactaaaaatacaaaaattagcaggatgtggtggcacacgcctgtagtcccagctactcgggaggctgaggcaggagaatcgcttgaatccgtgaggcggaggttgcagtgagcagagattgtaccactgcactccagcctgggtgacagagtgaaactctgtctcaaaaaaaaaaaaaaaatcaactattaaataaacccattctaaagtatatatcatcattctttgaccaaacatcagtctatgatagactgcatattaagaattttacatccttgtaacttactgtatggccatcaaatattttgattattactcctggttaaatgaataacaagtattttaacaaagactgtgattctgctttgatcaaattttttgagccttttaacatttttgacaaacatccttaaaatcaaattctaaattaagtttctgacttagacttattggtgggccttattaaagctacacaattagtcaccacaaagttataaaatatttttacagcttccggtcagaccatgaactccagtatcaccacctccagtctaacagttacatatactgggagaggcatcagttaaatgactcttcccaccccgtccccccttgaaagggtcccttatcagacgctattaactaatccttgtactattaatttacagggctttgactcctggatacatatatctcatctaaaacaagtaccaactcttttttttttaattattatactttaagttctagggtacatgtgcacaacgtgcaggtttgttacatttattaacttttttatgttttataattatgagataaataaaatcacggattaaaataaataaataaataaataaataaaacaagtaccaactcttgctcaatcatgaatgttgacaccagtatctgacatcaaactcaagttaaccaaagcctcatcttcagacccagaaaaaggtgacaatcaaaataaactgcttttgtgaaacacagggccagaaattaaaactattcaatccctttaggcccggggactatcgttaaagagatggccacgtgaaattgtaaggccaggtttgagggatagaattagttcagatcctccaaaaaagatgggctcacagatgcctaagagccgatggcccaacacatagaacttatagataaatcggttttgtaagcttactttttggcttttggtttgtggctcttatattgctcaaaaggtttttaaggaataatgaatgccttcccacctccattcccttttgtcctagaatgtttaattggctgtaagtcttttggctataagtcccttggctatatgggtcccattgaagaacagaatatatctgagatagatagccacaccacctggtaataatatggaatgaaataagagcttggctattgatgctacttttggcatattttgaccaaaatgggggaatgtgaattaaagatgataaatcctaagccctctactgaactgactgaacagatccccttgtggcttagaggccccaaaaaagcttaaaactaaattcctgaccataacagcatggaaagtcatacaaacttcttcttttagggtctagacacaactgagcatcattaatgttaaaacagatatcataagatggacagaacagactctttgtggcaataagatcttacaaacaccataaagttttcagtttattttaaaactactcttaaaattttggctcatgattctgacaacaggaattctaatctatacagtggacagcagtcctaatatattcatgctacatgcctgaaatcctggaccaggaactggtaaatacttgtaggttactgcccggcagtttcattcctgtaattctgactcttaccctaactcttgtccttgccagcaagaaaaagctagagtgctcttcacccaattcccaccatattagctcttgcctccagattgacatatgataaagcccagggggaaccgaaaccatccctgtaaactttataaaattaatcagggaaaaaggaagagggagaaatgaaaataaaccaagcttgcagctcatgcagcattaatcattaggccaggttgttgtctgactggatttcccacagttgtgttgtccctattgcctcagaatcatgtagactctgttaaaagattatagttctctttaacttttgtatagataataatttgaacattacataatgttaagtttttcctttctgatgttctttcaggtcctgcatactgatgaaactactgactcagctggtttgaacaatccccacagatgccagctgatctgaaggaccacacaggagctgacttaccaaagagtacagtctctatatcctgatgatttcatcccctattcccctctcaatcaatcaccccaatttcccagcccccttccatccacaatccctttaaaaagtcctgtgggagatggatttgagggacttctcccacctcctcccttggcaccctgtgataactaaactcttcctctgctgcaaaccctgccatctcattgtaatggggctgttactgtgcagtgggcattcgaacttgttggtcctataacactgactcacctagagcaacttcaggtcctgcaagctccattcatggtaagtgtcttatacaagtgtaccatttttatcctttatactttacttttctatgtaaagaaaagtaacttttctttttactttaccatacttttacttttctatgtttatatatgtttagatacacaaacaccattgtgttacaattgccaatttatacatgttcgtagaaaactattttctttaaagatttttacttatttgtatgcaagttatttgaagtcttttataactcatttagtagtgattcacaatgtataatttatatataattgtaaaactatcataaaataaactcaaagtatacttattcctttcattgaaaaataaagaaaacattaaaaccttcatatatatgtttgtgtatagagatatatgtatttatacatcacatttaagtatataataatacttcttccacctatttagaagcagagtatagaaacaaatagtatatttggtataaatttactgtgagctgtggtttcttataagattaggaaaagctagtctttaaaacttcaaaggaaagctactctactttctaattgtgttgataaaagttagcaaaaattcccttcatcacaaaacctaaacatgtagtgtaattatttacacatctgtttcaacaattatcatataagctcatcagggaaattcattgtcttcagctctctctaaactaccctaaaaggtattattatagtaatttttctaaaatttaaatctacttgtattattcacgatactaaaacacttcagtgccttcacagtacctaatggaaaaggtttaaacttcttggaggcaaaagtcttctgcttacttcttttgctttatttgctgatattcacatatattcacatagtaaaataaataatagacattctgtctacaccattttgtttagcaagggaagactttacacactgaaataagtaaataaatactgaagctaacagaactaagggatttatggatggagaagaaagaagagatgtttcctttgaggaatacacaatatacaaaaatagtataagtacaccattccttcttcactgcatataaactgctaaaggtagaatggggagagtgttatttctccatttctgtctatatgtctagtcttgaaatccaattattatatttatcaaccttagaagcttagacaaaacccatagagcctgtaagcctatttcttcatatgtcagatatgaataataaatgtatatactgcacaatctggttgattagattaaaaaagtaagacatatatatttattcacattttcctggcagattagatgcattaaaaattccaatcattattatcattttcattacgttatctgtaaatattacaatttaacttctagcttattgatgaaaaaatagccattggcagaaataaatacctgtctacaaacgcaagataacacaacccaaataagatcaacattttaaaacattttaaagcattatgaatgtacttcatttgatttagactgcaaaacaatagtgctaagtgagaaataagtatggttgctacttgttgccaaataatggagacttacattgttatagtgctttacagtctaaagtatcacatatctgagctcacagcagggtggtggggtgaacattatcccattttacagctgaaaaaaaatggagcaaaaggatgttaaattcctctctaaattcacagaagtagaatatagtgtttatatcgcataactttgtgaaacattcttagaaatgtataattaaaggcattaggaggtaacttttgggagaaataaaaagtgtatagttttacatactgtctactatagttatttattcaaaaatatttatcaaacctggaccatgttctatggactcaggtacctccatgaagtacacagtggtttttttttgttttgttttgttttgtttccttcttgagcttgcagtccagggaaggatattgaaaataaacaaaaaaaccagaaacaaagtaaacaatttcacaggtgacaagttccatgaaagtagcaaacagggtgctaaaagaaaagaaacacttttggggtactttctctaaatctagaaagaatgctaagggaacgtcaccttctacaggttatatttactctctagaagccatgaagagtaaaagtgacaagcagggaaaacatttcagacaaagaaggacagttatgacagatgctttgtggtgggatataagttggtcagttgtgaaaaactgaaagcctattagtgtgactggagcacaatgaaataagaaagaaaggcccaggttgagcctgtgggtataggtgggacgtgcatcggtagctgttcataagaacttacattttgttttatattagatggaggctcgttaatggttttaaacaaggacatgatgtgatctcatgatctcatttatagtataaaaggtcatttggaagagaacatatttgagttgtggaagaatgtcagcagggaaattaattaggatgtcacaaatctcgtgaggtgtgcactgggctgtgatcttcagcagcctatctctggagactgggctcttagccagcacaaagtatggcccatctaaagaagcattttcatcataatgatggcagcagtggcccggttggagcagccgctgtgaagacacagctccagtgaggaaggctcggccagggctgcgcactctgcggagccagtgggtgctggaaacaggtgatcccaggggagccctgtgccctactgagttggtgggacaggagcttgcgttcccgctgcagccgcccagccatggctttggactccggcatccctgtactctcggggccgggaaagcccccgcctccacaggctcagaagttcctgttcccactccctggcccctccctgctcccagtgcctgctctgcagtggagcaaagttgcgactatgtcctgatagccgagcccaggcgctgtagcgacccagccaggtgtgtgcacactcgcggtagtgctgacacgccagctccccgctgtctcggccccctccagaaactgcttctgaggctgaaatgttgggtgctgatgagcatggaagagaggctgggggctgacggtggctcggtgcgggcctacaggcacccctgggagcagtcagcctgggggccatgaacggcctgttgatggcagcgggagcagacagtttcctaggtgggaaggggtgtgtacctggcaggtcctgaccttcaggcctggcggcgagacggccatttccggatggagaccacaaccgggagtgagaattttttttgatagcttttggccaatggaatggtgtttttttcaagccctcccatggccacctgtaaccaatcagcactcacttcatcctacccgtgaaccaattagcatgaacttcctccatcctgagccccataaaaaccttgcactcaagcccctggggactactgcctgtggatagcggttacctgtgtccggtctcatctcctttgagagctgtatggtcacctaataaagctcttccccaccttgctcaccctccaattgtctgagtaatctcatttttcctgaagcaggccaggaactcaggacccccagactgcgggagcgaaagaagctgtaacatttccctgctggctcactgagctgtgggctggagctaaaaggcctgtaccactattaaccctcacaccctttgccagcggccaccccacccaaccgggaagaagtggtggggccggagcggggcagagggactgaaagagctgtaacacaaacaggctaaacacacacaccccaccctcatccacttgctgtgggcgacaaggagagaaggtctgaagcctttctgggagtccatgccttcaggctctctgacccagggctgtaacatgctgtaataccctctttggggctctgtggttcctggtgtctccgagctttggggtgccaccgcgttcccgttgtccagaaactggcgcctgcagcggaagccgcggtacgtctggtccagtagcagcctcgcatgaagccggagcctgtgctggcacctggagctgcccaccccgaggcagcagccagcatgcctggctgtgcacagtggccagacccgtgttcattttctcccttgctgttcctcgcctggctgacccttggcaggtgtgggatccgggctggtagcatgagccgagcacagcctgccgggccaagtgggtgaaacaagcccagcaggcacggacaaaactcaagcagaggcgccagtggccacagaggtttgtggctggcgaagccataccctaaggatcctgtgacaataaggtggtacttcttgttaaagaatgaaaatcaacttcctaaagtgatcatgtatatgcccaaggaatgtgggctgcacattttgaggtgtgctctaagcactggaaataatatcaaagagcacaatgtcatccttccaaaatttccttgttctacatccatgaatagaaacctggcttggagaaaccgaaatctaacataagaaaattgttaatagaccagtaatgttattttaatactgatataccagtatgttatatttacaaatctgaaaagcaatttccaaccctaaaagttatttaaactctgcaggaattacttttttaaatgttttctgaacctctgattcgaggtctcccttacaaatgtttgttcaagagatgtaattatgtggtattacttttaccacctgtaatgagttgatttaattaagattactgaatgaaggatccttaaaaacttaaaagtagaattaccatacgatgcaacaatctcgccatctgtatgtaaagcagatgaaatcagtatctcaaacacctgcccatctgcgtgtgtgtgtgtgtgtgtgtgtgtgtgtgtaaaatgtatcatttagccttaaaaagaaggaaattgtgtcatttgagacaacactgatgaatatgaagcatattacgctacgtgaaagaagccaggcacgaaaaacaaaatatggcacaatgtcacttattggaggaatctaaaccagtgaaattcacagaagcagacagtaggatggtggtttccaggatatgagagaaattgggagatgttagcaaaagcgtacaaagttttaatcgggcaggatgaataatgtatagcatgatgactatactatattctatatagaataatactatatagtataatataatataatatattatataatggtatatatactatataactataatataattataattaattatatatagtatagcatataattatatagtatatatataaaattatatagtatagtatataattatatagtatagtatatgctatatactatatatactatactatataatatatattatatattagtatatatagtatatagtatatatactatatatagtctatagactatataatatatactatatatagtctatagactatataatatatactatatatagtctatagtctatagactatatatagtctatagactatagataatatatagtctatagactatagataatatatagtcatatagtctatagactatagataatatatattatatagtctatagactatatatagtatatattatatagtctatattatatatagtatatatactatatatagactatatattatctatagtctatagactatatactatataattatatatactatatattatatataatatatagtataattatatatactatataatatatagtatatatattatatagtatataataatagtaaatatagaagaatactatattgcatatttgaaatttgcgaagagagtatatcttaagtacttatgggacacacaaaagataactatttgaggtgctggatatcttaattaacctgatatagttacatttcacaatgtacacagatatcagaacatgatattatacattacaactattataaacatatataattttttgtcaattaaacctcaataaagctgagggaaagaagagttgctgtagttgtgaacagaaggggattctgcctaactaaattacaaagaggctttaatcaacggatagcctggttgttgacaggatgccaagaacagctaagaaaatgtgctccacctgggagaatggaaataatggcagctaaagaaactgcagaagttgggcttgggagaacttcttttgaaatgactttaccaaagttcaatgctagtgatttttattttctaggtctctctattctaggctaaaattctcaggaaggatgatctgatgacccagctttgatttacctctggatcaatcagctagagctgcagatgtaagacccccaaaagggctcagttttttttttaactgagggctttccagggaacagaacatttctgtatgccagaagctaaaccaaaatggcatattttagactctaccttatggctgttttcaggcatgcacacacatgcacagacatatagatacacataaagttattcccctctatccaaatgtacgtatctaacatgatccacataaactacacactcattcttctttcacaaaagaaaaaactggaagtcactttcagatattttagtccgtattctttagagtgttcaatactgacagttgttttataattccatctcaatattcaaatactttagaaacaaatggaaatttaatgccttgtctatattatatactgaagaacaaaagaaacacataaaatacatacttaaagatagaattaaaaataaaaaattattccatgcagcaaacaagaaaaaagcttcggttctcatctttgaaggtcataagactctagggagcatgtaccatgtctcttctcaacatcttcgccttcaccttttattctagctgactggggcagaagaattctcctttgggaattcctttcaaagaccacagaatacaggaagttaatatttatggactattaagtgggatacagagaaatgttactacataattctgatctatttgtcatgattagggaacagtgcttcagggaatgttttgaatcctgaaaaatgcttgccaatcctcacagggtgtggtctcattataactgaccacataactgaatttttaatatggcagtattttgttttatgggtctagatgctttgggatataaaggtacttttcaagaagggtaaattcttgtataattgcttcctaattattcttgccagatatatatatattagtcagtttcagggatgggagtttcatgctgctccatgaatttccttcatctttggaattatgatcattgttctttcacccgtttactgagtagatttttcgatgagtaaacatgaccactggcatatgtagatcaactcggcagcctgttcagaataataataatagtagtgctaatagtaatgataattttctggtaatcaatcaaaaatatttctagtctccatatttttctgagaggtccatttccataactaactctcgattttccattggaacaacctcattatctaagtcatttactattttaaacaatcattactttgaaagtgatatggatctttcattaaggctatccattcaggaaagctgagcaatggtgagtacttctggaagctctgaccacttggaagatttccattttgagtgaaactgtgtagcattccattcccagcaagcactggtattaacatagagaatcaatgtcaatctcaagcagttatttttttcactttcattggccagatagtatcccctgagatcacagtttataggctaagagaaaatgcaaatgtagcaggcataggtaactgtattagtcagttatactgttataaagaactgcctgacactgggtaatttgtaaaggaaagaagtttaattgactcactgttcagcattgctggagaggccttagaaagcttaccattatgtcagaaggcgaagggtaagcaagacaccttctttacaaggctgcaggaaggagaagtgctaagtgaaggggaaagagcctcttataaaaccattagatctcgtgaaaactcactatcatgagaacagcatgggggaaaccacccccatgattcagttaccttcacctggtctattttttgacgcatggggattatgggaattacaattcgtgatgagatttgggtggggatgcaaagcttaaccgtatcagcaactatatactaaatgtagacactagtgaaatataaactctgactaaggttatgtaacctatttcatatatttctataccaccaaaatgttattgcggtgtggacgtggataaatatttttaacttaagtaattattttgctttcatatcctcttaaatgccatctggcatgcaaatatgtaaaataacaaaaatacagattgccatattcttctatcactcctctgtaattagcaatgaactacataaagtaccagacatttgggatgtcatttagcttgtgtgactccctttgtgagctagagcagagaataagcagcttgctctcctgattgggaatttcatagccctagttcctgttaactcactcagaaaacacagctgtgcatgttacctctgaatgcccacctcaaaaagatgcatttttaacagtcattgtcttcgttcaaattcagtgttatgtatcaaagcaaacaactaccaagattgctggataaaaaaaaaggctgcattattacaggtaaaacaaatatttcatccctaaatctctactctcttggagaccacttggatgtttggtttttgttcaaattatctctacattacatggcagagtgacacattagatttaggatatttcttaatttgaaatttacctattggtatttagatggttcaataattcataaaatgatttaacagtaaatacactgaatattttaacattattcctgtgtataaaatttatcttctattttttggaaagtatatgatgaacttggaaagtatatgatgaactataactgaaaatatgctaaatttttccataagaatattttaaaagagtaatacttgagaaaaagagaaattctcatacttttttcccttttcattagaaacacatgctatttagctcttctagaaagtaaaaaacactgaaattaaaattcctaccactcataatgtatatattgatttttgaaaaatggaagaaactaatattttaaaactacatttattattaacttattaatactaatatttgacccatgagttagacagtgattgtaaaaataagtataaaaatagtgctcaatgttagtacttgtattttctgatttcatcattaaaatttcctttcaatgtacatacaacataacagaattaaagttactcctgtataaaaaatgtatagtaattatgccttatgtctctttggtgtttgtatccatttttgttttgtcaataacaaaatttttactaacatgagacattattctccatcacagggctgtttatttgcagaattttatttacattcacagaaaacaatgtgaatagtggtctcttgtgttatgctgcatatcatctatgctgttatcatctatactctctgttacacaaataatacattttaaaaaggtgaaatcatagataggattagcctttaaaaatccacttcagtccatttttaaaaaataatttgacatgatctatcatttgcactttctttgaatgctccttctcaatccatgaggtttgcctgatttgtaaaacttagtaaaataaattaagagtcatggcacctggcggggtgcagggttgggggagaaacacatgtcacctgttggatatctttatgccatcattatttgattgattgattagttgattgattgagacaggaattcactatgttgccaggtcttccctgggctcaagcaatccttctccctcagccttccaaaaagccgagaaacatcaatattttaatgtgcaccctatattcactttaataaatattaatttgaggttaatatgttaccataatttactatgacaaaaactgaaatatataatacaaactagtacatagttcctgccttcaagaagttagtaatctgataagaaagacaaatatataaacctaattatcataccatatgataaagtccataatggaaagagctcaaaatagatgtatcacataaagcataaaagaattctccacaaaatatcttatatcacaggaaaaatgaaaagattcggccagcatggtgactcacacctataatcccagcactttgggaggcttagaaagggagatcacttaaagccagaagttcgagaccagcctgggcaatatagaaagactctgtcactacaaaaaaatttaaaaaaataacaaggcatggtggtgcacatctgtagtcacctcttaggaggctgatttggaagaattgcttgagcccaggagtttatggtgagccatgatcatgggactatactgcaacttgggtgccagagtgagatgctgtctctaataatgacctctttcaatgtgctagtactttataatacatacatattgctcaaaacccttgactgaatttcatgtggaaaaaatagacttattttcataaaatgtactgcaatattttaaataaaccagtatgtaaaaaaaaaaaataaccaacttgatctacatctcctactataaatgtattttgtacatggaaatcacttgaaatgtgcataagatgtctatgtatgatgttgacagaaagaagaaaggcatcacaatattatacatagtgttagactttcttggtctttctagtcttgtctcaaacactttttcacactgtattttatatttgcctcctgcttttgcatactgttgtatgagtcaacaaccagttgaaactcttttgaagaaaatgtagagatgaaagcatagagaataaaaaaataatagagtaaaactaagatattttgacaaaaaagagcatgccaaagaaattgtaggcatgctaaaaatgcattattagggtacacattgcaattataaatagtaaaataaataaatttataaattagcattcctatgcactatgtgacaagaatacagcattatttgttagaaaaaacatgcaaaattattgggaaaataaatggagagacaggataatcaaagactcagattatctaccaaattgactcagaataaggacatgactgtttgcaaagttaaacgtgaagaccatgacagggggaaaggagttgtcaatgaagttgactttcaaagcaagccttagaaattcaacagaatcaatatttgttatgcttatatcaacaaaataaccgtggaagctgcattaactcttcatgagaagactgttacttttctgtcctaagtattttttaaaaagtaaaaaaaaagactactgataaacaaaattgattgtagatcagatagggttaagaaacagatattgtcctgtgggtttattcctcagaagaataaagtgtctggttatgaagttaacaggataattttactgatcttggtacttgggctaaaaatattatgttaaaatccaaaataatctgtttttctgaaaactctgtttacttaaaggaatgtccaaaggaaattacgagttgcgtggaggccctcaaaccctacttaaaaagtaagatttttttttttgagaaatatgtacagttttacctcctatgctaaataaggcactaccagaaaaaaaaaaaacttgcaaacaaggccgtagacatttttgatgccttaacatttaaagagggatgtagaatatacccctaacatccaggtgattgtcttccctccaactttgacactgcttttgcaatccatgaaccatgattttatagttcatcacattataagtcttcacagttgtcaagacttattattctcaattacttattcaaaacctggtcatggtctaggtttgtcaaacaagaagctttgctaaaaattttttgaactatttaacatttagaaaggctttggaattcactgaccatgcatggcaatttttttttctccatcaacatcaagggatatataataaagaacaaatgccacaatttgtgattgatttaaaaggttttgtaaaggtggtcgaggatagcgtgaaaatttttcttgagagggatgttaactttgaagaggttaatttaaaaatgctgaagagttcttgaactcccatgctgataaattaactactatacttgctcaggaggatatataaccctggcttgaagaagatggagatagctacaagagatgcgtagtcaaaccacaggtgccatctactttgaaggaatgtatgcgccatgcaaatataaagctaaacattatcctcccatgtatcagccatctgatgaaaagccctcattttaatattgcctgatgtatctcattgcgtcattctcctggaagcagacaccaaggaagaggtaaaagggcaacagtttttttgttttttgtttttttttcattttctttctttttgtttattattattattatacttcaagttttagggtacatgtgcacaacgtgcaggtttgttacatatgtatacatgtgccatgctggtgtgctgcacccattaactcgtcatttagcattaggtatatctcctaatgccatcccacccccctccccctaccccaccccacagcagtccccggtgtgtgatgttccccttccttgagaaaaatacctgtaaaagtaaatgagagacgggaaagtagtacgtggggtccaccttcagaccacaatgcaggtctgatatcagtgaatgaagagaggagaaagaagaaagaatgcagagcctcaggctataagaaaaccttggaaattcagagcagagattccccattagaggaattacatgtgggtcagaaatggctgactctggtaagttctctcgctgtgctcagtcataggctggagacaaccagaaggtgtatagtctcggtgtgaacatagatcctgaatgtacagcacttggaggctgtcagctaacgactccttggaagtatttgctgatgaagggatatctgatggatacatttccatggctgccaaatttagagaacgatacaaaaattttaaaggatagaaatggtgttaattgaaacaaattgaaacattttgaaataattgttattccaaaattttgtgcaccttccctgaagcctgctgttctggaatctctacagcagatacgcaaagacgtgcagacacacacacacacacgtatgatagatagacaggcagacagacaaacagatagaggtcccatagataggtaggtaggtaggtaggtaggtaggtaggtagatagatagatgacagatagatagatagatagatgatagatagatagatagatagatagatagatagatagatagatacatgtttgtatggcagttcctctggacagtttacctgaaattacccttcataactgaacaactcctctgcacgtctccttcagcaatttgtagtactgcttttgcactccttatctcctcgcatctcagttttcttcaatgtcaatttaatcatacttggtaaaatagtaatagttcaatatagaaaattgctttgtttttaactgcatttttctaaatctttttataacaaatttatttattgttatactttatttatggtgtttattttcaatgtgaaatttatgtcacagcaggcaacctgtagattttaccatttagaatgcaactgtttgttagcaaccatgttaactgtttagtaatattttaagtactttatattttattataatagtttgatacatataaatgttttaatactttaaatacattttaagaaattaatttgagatttgaatttatgtggaaacatcaggaaaaagcaaaagccactatttgtttgaaggtttatcacaacttggaggatctctaagtttaatcaacctctgggctcagaatataattcaaatttttgagcatttcatcctgggacctctacctatttgtccaatcagcctcatcttctactattccacacctcacactttatactctaatgataacaaagaacttgcatgcatgatacttgaatgcattatgctacttgagatttgcatttattttattataatattttctatatgtgaatgatccccatatacttattttctcaacctactaaaatcatatgcatgcttaaagtcttggcctaactatcatttctattagctagctgtacatctttctctgttcttcatcttccatagatgcctgttatacattcatcttatcacatagattttcaggtcaagaatgagggtttactcatcttttaaagaagaaaaagacaatttaaaaagtagatgtgggccaggcgcggtggctcaagcctgtaatcccagcactttgggaggccaaggcaagcagatcatctgaagtcaggagtttgagaccagcctggccaacatggtgaaaccccgtctttactaaaaacacacaaaaaaattagagggcatctgtagtaccagctctcaggaggctgagacaagagaatcgcttgaatccgggaagcgaaggctgcagtgagaggagatcatgccactgcactccagcctgggcaacagagtgagactctgtctcaaaaaaaaaaaaaaaaaaaaaagtagatgttacataccgcccctgcaccaaattaagctgtttttcagaaagaaaactttcattgtaaaataaattattcctacataaattatgatcttgtgttatcattgtaaaaagctctcatgtaactgcaaaactgctgcaattaatgttctactttctaatctgaagtgttcatcagaagaattagaaaatgtgaatcaatggcatttacactcttttgatgataacatgaccaaacttgttactgaatgattgtatctaaaattcatttttctctaaaaggattaattacataatctattttcctgtaaatgatatgtaagttaatgatttaaacttctacaattatatatctaaattaaaacaccaacttggggctaaatgaaaacgattaaattaatatatgaggatgattctaccaatttatatgaaatctctgttgtctaccacaactgtcaataaagaaaaatttaaaaaaatagcaaagtgacttattagcttaaaattacttaatatgaattttctctatataggttctctcaacatgtaattacaagaaaaattacacttgtattattcaaaatacctgcttttattttatgtatttaatctgtttatctcaacttttagataaagtggcaatcaatccgacaaagtaagtattgggacttaattagtcaggaagaatgggatgccctgaggctgttgtatacatgtcagaattggcaaaatatccactttctacaagcaagaggaagtcatatttcacagttatgatgcaattacattgttatttcacagctgtcaaaaagcataatcttgaaatatgactttttaaagtatgtacttaaaaactttctcaacattttaactaataatattttaggatcctaggaatactataactgcaagcaccctaaatagagaggaataaaccaaaatatattttatatgattttcaacataataaaaattatatattttaggttcaatatataccatacagcttttcataaatgtcaaatggaacacagaaagtaagattacaaaattacaacaaagacaaatctaagggttgaacaaaacaggaagtacatttaaaacatattttatttatttttcttttctagctctcacacatagtttatacataaattgaaagacataaaaacacactatcaaaagatacatgaggagatagggacaaagagatacatgagcagagcaatcaatgggaatcaagctgattttagtacacaaaatttatgccacaacatcctctataattgctaaaaatggaatgtaaattggactttggacttcttaatggggagtataaagaaaagtaattagataaaatatttagtgtgcccatcatataaaatgtagaccagattattagaagtcaggcaataacttctggttctatccagtgtgtttttatgataggctgctctgtaacaagcagattacatcctccagagaatacctaaaataaatatcatgtgagtttcagaagagtacagaatcaccgaaggctgtgcagcatgacatttgtttcaatagaacatagcactttgagaggtgaaagcaggacattttcaaactgtgtcctctgacgatgcagtgagtgtgggataaaagccagaataattaaagggattatggataatatatgctttaggtaatctctgcaaatgataatatttaaaaataattcttagttatatatcatttagtttacaattgtgtggtaacatgtcaattttataaatataatattaggtggggggaagcaaataacagaaaactgtataaatttaaataccatttttaagcactgattacctgaaaacaagtgaagttaaacaatatatttgcaaaaatatatatatatatgtttaaattatgaagttaattaggaaaaggtaaacaaaatttccactgtaaagaaaaaccctgaggctcattaaatagtattgatgcagtccataggtccataggtagattcactgtggagtttatgaagttcctcacttggatcatttccttcaagatccttctatctaatttaattttggaaattgtgtacacttttcttagaaaatttcccctaagttgtataagagtcagacccatcgaaacttgtaatcttatgaagtaatattctatttcttttggtattgggattatgggtattattttattacttagattcataaggtgtattagagtatatcatcttgtttatataaaatgtatctaaaaagaaaaaaacaattggcagtattactgaaattgctgtatctagaatataggtattatatatggttaattgaggatagatccattattttgacagtccagtgagcaaaaagaagggtttactttctctcattacagtgaacaatatactagggcaatatactgaaaaggataatcaagtcacttctaattgatatatcactcaaaaaaatgactgggattctgaagcagcaacatatcccagaactctatactaaaaggctatgaaaatatttgactgaaaaaatattaaagcagtttactgtagtttaaggggttggagggtgcttaagaagacaggtacattagtgatttattgttgtgtaataaattgtcccaaaacttaacaccttgaaacagcaaatatctctgaggtgataaaagtaactaacaatggaaacccggtattaaactcaattgctcattttctaccaagtttcccaagaaatctagcctcatattttgttaagaaaaaaacagtttgatatgcttgagtgtgggaggaatggctaataaactaataccataatttgggagaaataaggttaactcttttaaacagagctggagcatcattgaccaaaatgcattccaaagaacgctaatcctatgagatattctgcaaattgggaacataaaaaaatgagaataacaaatcacatcaaatccatgaccctgtgaaatcctggagagatgacattttagtattttcccaaacttatctaatctcaacattttttccataaatttatggacacactctaatcaaaactagaatagatcaggctcagtctggtcagataccacagcaagagaatcaatgaatgatgaaacccactattgtgagagactcttgcaaaactggagaagcatttattaccaatagagtatttaatttagcttgatcttttaagcaaggctccagtaagaaagttgtagaatgtctacaaaattctagtcagttgtagtattcaagctcataaactttatttgcttccagaatagagctatgtacacaatgccttgagtggtgattattttgttctgcaaccagtattcattgagaacttaagtaatgatctgatatcatttagagtatagcatccatatttgttgctagcagctttggaaacttacaagctttacaatttctacatgtagttataaaacccctgctgtacttgcaacaatggcttctttccctttatacttgtgattgttgagtagatatctgtgttttgcaaaaagaataattctagattagacaaattaataatctactagaacaacccttaaatcaatcttttgttaaaagcaatagcagaataagcataagtaaacataggtaaccgtaagtaacattaaattaaaacccttgtaagaatgagagcaagaagaaagtgcaatagtgaacgttgacatttgtgaggatatttcacaagtgtagttcatgtaagagttgctatatcatgagcagaaaatgtatcatgtcagttttgatattcttgaaatactgaaaacaatataaatcttcttcaaaaatatcaacattttacacagtacatgctactcatttatttctgtatgctgtatgctgtttgtataaactgactttcatcaaagttaacagggtttctttttttttttttcttctccaagttcaacgaaaacagttttctctcaaaatgtttgtcacaacctttggacaaacaaaagcccagagagagaaaagtaaacatatgtatccacatatctatcaatcttttgatattgcaaaccatttagacaggggaataaatgtttagaagagtagtagagggacagaagcctttcacttttagtccacctacacaaatcttacttctcaaaaacctgttatttgttgtgtttgactaacaagaacatgacactggagaaaatcgtatctagcaaaaaaaaataattttagcaattaaaatacattgattacataactacagcaatggactgtattttaaaaatatttactattcccttaagtcactctcctcatggactgaaacaggttggttagttcgctaaaaattaaactgaggtcaaagcaaacactgagagcaagttagtagtcattttttctctacaaactgacctaatcttgattagttttgtaatagtttcacgtaattttttagatagatttagtatttgtgcaattttaacaatctaacgttgtcttcatagtagctatgtatttgagtaacttgctttatcattgcgatctgcatccacagattcaaccatccacagattcaaccaactccaaattgaaagtgttcattaatatgcagaagaatgaaattggacatctcgagtctcaccactaaaaaacacaaaatggataaaccacttaaaaataagacctaaaacatcaagagattaagaccatcctggctaacacggtgaaaccccgtttctactaaaaatacaaaaaattagccaggcgtggtggcagatgcctgtagtcccagctatgctggaggctgaggcaggagaatggcatgaacccgggaggcggagcttgcagtgcgcggagatcctgccgctgcactccagcctggaagacagagctagactccgtctcacaaaaaaataattgaaaaaaaaaaaaactaaaacaataaaatattagaagaagacctaggggaaatgctccagtactttgctctaggcaaagattttatggctaacactcaaagtacaagcaacaaaaccccaaatagacaaatggaactatattaaagcaaaaaatttctgcatagcaaatgaaacaatcgacaatgtgaagagaaaacgtggtgaatgaaaggaaatacttgcaaactattcatttggcaaagaactaatacccagaatatgtaaggaactcacataatagcaaaaaaacaaataatcccattaaaaagtgggcaaaggatctgaatggacatttctcaaaggaatacatacaagtggtcaacaggtatatttaaaaatactcaatatcactaacttcagggaaatgcaaatcaaaaccacaatgagatatcatcttatccaagttagaattgctattatccaaatgacaaaaaataactaatggtggcaaagatgaaaagaaagaattcttatacactgttagtgggaatgaaaattagtatagccattctggaaaatagtatggcgatttccccaaaaattaaaaattaaaactagcacaagatagaacaatctcactactgggtattttatccaaaggaaagtaaatcagtatatcagaaggatacttgcacctccatgtttattgccacaccattcaaaatagcaaaaatatacaacaatctgttcatcaacagatgaataggtaaagaaaatgtggtgtataaatacacaactgaatactatttggtcataacagtgaatgaaattttgtcatttcgagcaacatagatggaactggaggtgattatgttaagtgaattaagccaggaacagaaagataaatatatcatgttctcactcatacatgagagttaaaaaattgatctcatggaaatagtgagtagaatggtggttaccagaggctggggagggtgtgcgtctgtggtgggggataaaaagaggtagattaatgggcacaaacatacagttagatagaataagttttaatattaaatagcacagtagagtgactatagttgacaatatattgtatatttgaagacagctaaaagaaatttgaaatgttccccacacaaagaaatggcaaatgtttgcaatgatagataacctaaataccctgacttgatcattacactttctatgcatgtaccaaaatatcacatgtaccacataaatatgtacaaatattatataacaataaaataattagaaaaataataaaagtaacaataaaatataatacaaataaaaataatgcatctaacaactatttacatagagttgtattaggtattataagtaatctagagatgacttaatgtacatgagaggatatgcataggttgtatgcaaatactacatcatttcatataaggaacttgaacatttatgggttttggtatctacaggagtcttggaaccaatcttccgtggatataacagaacaactatatctctatatctagatatatatgtcttgttttcaatataactaaactaaattttcccttttaaactttcttcaactccttaatcttttattttattgataatgtcattctctcatagtatctcaggatgagatcttcaagaaatcttagttacattacatgtcagttggtctccctactgtgggtatatctcatactacaccagcttgacaaaatacttgcacctccacataattctgattctctccctcttttcatggtcttcactgttcacaaatgtactctcaacaccaaaaagtgatattatgcttctcaatattattttcctttctcctgaagctttgtttccttatactgtccttcaaatattctatacaacagtaacataaggttatttttcatactgcctcactctgtctcctgtgcccatatatgctcttttcttttttggcctttttttatacagcttagtttattcttttgaaagatactcttagtataatatatttcatctgttaaaaaatactactagctagtgaaagggaaaataaaacatcaacattatagcatatacttattctgtttcccctggcaggaataacctaaaaatatttcttgatatacttgtctggtttttccactagcttgcaaacttattaagggaaaaaaccttgtaaaaatcctctgatagttactttagaataaacctaaatttagaaaagtgatatgtaattgttgaagaaataaatgaattaaaatgagttgccaagaaacgtgaataaaatgctcaacatcactaatcactaatcatacacaagtcagaatgactattattaaaaaatcaacagatgttggtgaggatgcaaagaaaaaggaacacttatacactgttagtgagaatgtaaattactacaacctctatggaaaacagtatggagatttctcaaatactaaaaatagaactaccctctgatctggaaatcccactgctgggtaattactcataggaaaataaattattgtattaaaaatacacctgtgctattatgtttatggcaacactatttacaatgcaaagttatggaatcaacctaagtgtccatcagtcgagaattagataaaatatcacacacacacacacacacatatcctggaatactattcagccataaaaataataaaattatgtcttttgcaacaacatgaatggaattggaggccattatcttataagaaataatttagaaactgattaccaaatactgcatgttcttacttattagatggaaataaacaatgtgtacacatggatatggaaaatggaataggagacattggagattctataaggtgggagggggatggtggttaaaaaattacctattgggtacaatattcactagttgtatgatggataacgctacaagcccatacttcaacactacatagtacatccattgatatgatttggctatgtgttcccaccagaatctcaagctgaattctaatccccagtgttgaaggaggagtcttgtgggaggtgattgaatcatggaggcagatttttcccttattcttcttgtggtaatgaatgagttctcatgagatctgattgtttaaaagtgtacagaaactcccctttctctctctcttcctcctgctcccaccatgtaagacacacttgcttccccttcggcttctactgtgattgtaagtttcctaaggcttccccagaagcaaaagcctgtacagactgctgctatattaaatatagcttctttataaattacccagtctcaggtatggtatgtcttcatatcaacgtgagaatgaactaatatgtccatgtaacaaaactacactataccctctaaatctacaaaaataaaatttaaaaaattataattttatatagtacccaatcatttttcaatggtatttatttgtgaaataaaaaaatagtacacattcaaattttttaaattaaaaaatagatataaatataatgaagtgatgtttgcttctggagaaagtgctataacatagggtgaatgtatcctcctacttgaaacaaatagacatctggacaaaatacttgaaataattgtttttgcatattgaaacaaaaggctgcacaggacactgattcctgagagagtggaaataaaagagatgaactctatgagtgaccacaacttactatattgagagtatagatggttcctgaattataatgtttgcttttttgtttgtttgatcggttggctggttggttggttttgagatagagtctcactctgttgcccaggctggagtgcagtggcatgatcaaagctcactgcatccttgatttcttggactcatgtgatcctcccacttcagcctcctgagtagctgggactacaggtgcacaccaccatggctggctaattttttatagttttgtacagacaggtctcactatgttgtccaggctgctcttgaactcctgggctcaagtgatcctcctacctcagtctccaaaaatatgaggattccaggcatgagccactgtgcccagctgcaactaagttgacttaacaatttttcaactttgcagtgatggaaaagccatatgcattttagaaaccacattttaaattttgaattttgattttttctcaggctggtgatatgcagtatgatactttcttgcaatgtttggcagtggtggcaggatgcagctcacagtcagccatgtgattataaaggtaaacaactaatactctacagattctaaagtgtactgtgttgccatgtgattttactcaactgtaggctaatgtaagtgttctgtatgcttttaaggtaggctaggcttagctgcaatgtttggtagtttaggtgtattgaatacatttttattttacattatcaacttatgagtggtttattgtgacgtaattttattggtaaatggggaagtatctgtatatacacaccaacattcagggaaagtgaaataaggcgaagacatggactaaggttaagagatcaatgcaggaatccaaggagtataggcagcaaaagtcttcaggaaagagtactagtgatgataagcctgtatagagagctctgtattcaagcagaggatttcctcaagtcactactaatttcagagtaacccatctatttgaggaaactacactaggtcatagaaagtctcatgtgaaatatttagagtgaaaaaaacctaagagttcacacaggtctagaaataatttatttgccattaataataatatttaaaaaatggtaattgagggagcaccaggtaaaacactaacaaatattatgcctcagtagtgtgacaaaattagcccatgactaaaagctgtaccagcaccatgtaacaaaccttaaaagcaagactcacaataataaaagtgtttaaaataatttaacaatattctgggacaaagctcaagaatattaatgagaatacaaaacatgtagcataaacaagtttaaaaaattacaatatcttgcacccaataaaatatttctagaaattcaagaaagcaataaaatgcaactataacgagaagaaaaattaatagaaacaaatctaaaaatgacaggaatgagagaattagtagacaagtatattaaaccagctattattattatatttcacttcatcaaaaactgacagaaaagagtgagaaaattaaacataaacaagaaagctataaaaaacaaaactcccagagccaaaactacaatgtctcaagtgaaaactacttttgataggattaacaacaaattagacacttcagaacaaaagattagtgaacctggttcatagaaacaaaagttatgaagcagagcattagtgaactccatggaacagcttcaattggcctaataattgtgtagagtctctgaagaaggggaaagcagaaaaatacatatacttgagaaaacaaccaaacctgttcaaaattaataaaaacatgaatataaacatcatagatcaggaccaagaatatggatatgcagtaatctaagccagagtttctatttctgctatgcaatgtctttgtttaggaaaattactagaatttcctacattttctaagatccaaaacaaactcaagcataggtaacataaagaatagtaactaacaacaggtccatctgacttaaaacgggttatatttacagtaagcattaaaagttatcagttttttttaaaatgtatcaatgaacaaagatataaatgacagcagacttcttgatggaaacaatgcaagttgaaaagacaatgggccaatattttaaagaactgacagaaaactactagtattaatttttttaagaatttcatctagaattctatatcaagtcaaaaatatctttcaaaaatacatatggacataaatgcttccacaatgacagaatatgatcatctgaaaatttgtttgtccataaaagcaaaaagaacattggcaaaattgttaaaagccagctatttcagaactctaaaagttaacaccagtctgagaacaatgtatgaaacatttgtcaaacaaaattagattaatatatttaggaagattgagctttgtggtgttttaatttagcccatctccatccatttctccccagctatgtgaaacattgaaaatcagcagtctttcaatcattgtagctttgaatacaagcaacctagcagaaaatggaggcatccaaataagattcaagttctactaaaattcttgtcaccagagaattttcactatttgacctgtctgttagctccctacaaatgtcccatttatgacttcactcagagctcactcagggtaaacaccaccagacatatgttggtgtttggacatatgtcatatataagttgaaaataattagtggtaattatttaaaatggcagttatctgggggcagtgataccaactgaggcaagggcctacccacaaatttaaaactacattttacaaaatgagatgtccacaggggactctgagtaccccaacatatacaagggaatctaaagttgacacatacagggagcattgtgtgtacccagaaaaataacctgagaagcactgttctctcaattctggttgatcctgaggtttttcacaagcaggaagtaatggttaaggcagaattgtaaactgcccaagtattgaaaacttgccccaacatacaaacagagacccttaacagagaatgagagacttattggcttaaagcatttaagagaatctttattgaatcattagctgaccactaacctaatgaagtggaaacgtcaatggtcacagacaacataaaacagtgactttaagaaattaggccatgaaagtccctacacaatcaaacagcagcagcaaaagcaaagatagcaacaaaataaatcctggacagtggaggaagaaggggaagggaggaatctttagtttccccacatagaggtgccacattatattattttaaatgtgcagttttcagcagcaacaacaatcataagaaaagcacagacagagaaaggtatggtctatgtatggggaaaaaagcactcaataaaagttgtccattaagaaagacaaatgttgggttaatttttagaataatgtaaatcagctattataaatattttttatttttataaaataaaaaattttggttccatgtctccacacccaaatctcatctcaaattgtaatcctgataatccccacgtgtccagggagggatctggtgggaggtgactggatcatgagggcggttttccccatgctggtctcgtgatagtgagtgagttctcatgagagctaattataaagggctcttcaaaaggggccctttataaggggattttaatgggctattcataagtggctctttttagggggctttttaaaggggctcttccctctttgctctctctgctctctctcctgccaccttgtgaagaaggtgcctggttcctttccaccataattgcaggtttcctgaagcatccctagccgtgcagaactgtaagtcaattaaacctcctttgcttataaattacccagtcttgagtagtatttttattgcagtgtgacaatggactaatacactaggtataaagaattataggaatatatgagaacaatattgtgcacattggaaaatatcaatagagatatagaagttattaaaaacaataaagtaaaaatgttggatttgaaaaggaacataacagaaactaaaaattcactagaggggatcaacaatagctatgagctggtagaagaaagaatcagcaaaccctaagataggtcagttgagatgaaatcaaaggaacataagaaaatgaataaagagaatgaacacatcctcagagacctctggggcactggaaagcatactaacagatatattgggagtcctgtaagaagactagtaagaattactctaagttgactatagtaagttaatatgtattttataagtcctaaaacaaacactagaaataaaacaatgaattatatctactgagaaataggaaaagtaaaatggaaatggaattatataaataatcctcaatctaaaaatggataaaaatagaaaagaaatcagaaacatataaaattaatagaaacatagtaaatatatccatacaataatgacattaaatgtaaatggaccaaatgtctcaattaagaggcagagaatgttagacagaataaaaaaccaagacccacctatatgctgccttcaagaaacatactttaaacctaaaaatatgaataattaaaaacaaaaggatgaaaaggatgcaaatgtgaattaaaagaatggggaagtggctatattaatgcaagccaggctctatgctagataaagttttgaattaaaatttttacacaattcttgctgtgaagaagatttgaattaaaatttttacacaattcctgctgtgaagaagattttttttctagctaggaatataaaaattgagtaagtacacaggagtcatacacaaaagagatgactctaatcaatgtgtgcatataaaacaaatgacctaattctcttcctgaactgtctgaaatttaaaacaaacagtagaatcttattttaaagtacttttctggataaaataattataaccgagcggatgaaataaaattgagcaaagtactttttactctctccaaatcagacaaccttaatatgttctgattttattaaacaacttatgctgttgtagttgtggttgtttttaaactattaaagagaaagttactctataaggcagtacagattaagataaaagagaatggatctgaagtaatccaagccagaatatgaatttctgctataaaatgtatttatttaggcaaatttttgaaactttccattattttctagtgttattattaagattatggatactaaataactagcaaagtacttgagacacattactaaataaatggtaatagaattattccctaaaacattggaaattgttctgttccaaggtggcagaataggaatagctctagtctgcagctcccagtgtgattgacacagaagacaggtgatttctgcatttccaactgaggtacctggttcaactcattaggactggttggacagtgggtgcaacccacagagggtgagccaaagcagggtgggtcatcacctcacctgggaagtgcaaggggttgggggatttccctttcctagccaagggaagccgtgacaggctgtaccaggaatatcgggacactgccacctaaatactgcacttttccaatggtcttagcaaatgggacagcaggagattatatcccatgcatggctcagctggtcccatgcccacagagccttgctcacttgctagctcagcagtccaagatcgaactgccaagcagcaagcctggctggggaggggcatccaccattgctgaggcttgagtaggcaaacaaggtgaccaggaatcttgaactcggtggagcccaccacagctcagcgaggctcacctgcctctgtagactccacctctgggggcagggcatagctgaacaaaggcagtagaaacttctgcagacttaaacatccctctctgacagctctgaagagagcagtggttcttgcagcatggtgtttgagctctgagaatggatagactgcctcctcaagtgggaccctgaccccgtgtagcctaacttggagacacctccaagtaagggctgactgacacttcatacagctggtgcccctctgagatgaagcatccagaggaaggatcaggcagcaatatttgctgttctgcaatatttgctgttctgcagcctctgctggtgatacccaggcaaacagcatctggagtggagctccagcaaactccaacagacttgcagctgagggacctgactgttaggaggaaaactatcaaacagaaaggaataccactaacatcaacaaaaaggacattcacaccaaaaccccatctgtaggtcatgatcatcaaagaccaaaggtagataaaaccacacagatggggagaaacaagagcagaaaagctgaaaattctaaaaaccagagtgcgccttctcctccaaaggattgcagctccttgccagcaatggaacaaagctggatggagaatgactttgaggagttgacagaagtaggcttcagaaagtcagtaataacaaacttccctgagctaaaggaggatgttcaaacccatcacaaggaagctaaaaaccttgaaaaaagattagatgtatggcaaactagaataaacagtgtagagaagacgttaaatgacatgatggagctgaaaaccatggcaggagaactatgtgacacatgcacaagcttcagtagctgattcgatcaagtggaagaaagggtatcagtgattgaagatcaaatgaatgaaatgaagctagaagagaagtttagaggaaaaaagagtaaaaagaaacaaacaaagcctccaagaaatatgggactatgtgaaaagaccgaatctacatttgattggtgtacctgaaagtgacggggagaatggaactaagctggaaaacactcttcagtatattatccgggagaacttccccaacctagcaagtcaggccacattcaaattcaggaaatacagagaacaccacaaagatactcctcgagaagagcaaccccaagacacataattgtcagattaaccaaggttgaaatgaaggaaaaaatgttaagggtagtcagagagaaaggtcgggttacacacaaagggaagcccatcagactaatagcagatctgtcggcagaaactctacaggtcagaagagagtgagagccaatattcaacattcctaaagaaaataattttcaacccagaatttcatatacacccaaactaagcttcataagtgaaggagaaataaaatcctttacagacaagcaaatgctgagaggttttgtcaccaccaggcccgccttacaagagctactgaaggaagcactaaacacggaaaggaaaaaccagtgcaagccactgcaaaaacatgccaaattgtaaacaccattgacgctaggaagaaactgcatcaactaaagggcaaaataaccagctaacatcataatgacaggaacaaattcacacataacatattaaccttaaatgtaaatggactaaattccccaattaaaagacacagactggcaaactggataaagagtgaagacccatcagcgctattagtgcgctgtattcaggagacccatttcatatgcagagacacacataggctcaaaataaagggatggaggaagatctaccaagcaaatggaaagaaaaaaaaaccaggggttgcaatcctagtctctgattaaacagacattaaaaaaacaaaggtcaaaagagacaaagaagggcattacataatggtaaaggatcaattcaacaagaagagctaactgtcttaaatatacatgtgcccaatacaggagcacccagattcataaagcagtccttagagacctgcaaagagacttagactcccacaaaatagtatagggagaatttaacaccccactgtaaatatcagacagatcaatgagacagaaggttaacaaggatatccaggacttgaactcaggtctgcaacaagcagacctaatagacatctacagaactgtccaccccaaatcaagagagtatacattcttctcagcaccacattgcacttattccaaaattgaccacatagttggaagtaaagctctcctcagaaaatgaaaaagaacagaaatcacaacaaactgtctctcagaccacagtgcaatcaacttacaactcaggattaaggaactcactcaaaaccgcccaactacatggaaactgaacaacctgctcctgaaggactactgggtacataacgaaatgaaggcagaaataaagatgttctttgaaaccaatgagaacaaagacacaacataccagaatccctgggacacatttaaagcagtgtgtagagggaaatttacaacactaaatgcccacaagagaaagcaagaaagatctaaaatcgacaccctaacatcacaattaaaagaactagagaagcaagagcaaacacattcaaaagctagcagaaggcaagaaataattaagatcagagcagaactgaagcagacagaggcacaaaaaaccattcaaaaatcaatgaatccaggagccggttttttgaaaagatcaacaaaattgatagaccactagcaaaactaataaagaagaaaagagagaagaatcaaatagatacaataaaaaatgataaaagggatatcaccaccaatcccacagaaatacaaacttccatcagagaatactataaacacctctacgcaaatagactagaaaatctagaagaaatggataaattcctcgacacatacaccctcccaagactaaaccaggaagaagttgaccccctgaataggccaataacaggctctgaaattgaggcaataattagtagcctaccaaccaaaaaaagtccaggaccagacagattcacagccggattctaccagaggtaaaaagaggagctggtaccattccttctgaaactatcccaatcaacagaaaaagagggaatcctccctaactcatttgatgaggccagtatcactgtgataccaaagcctggcagagacacacaaaaaaagagaattttagaccaatattcctgatgaacatcgatgcaaaaatcctcaataaaatactcgcaaactgaatccagcagcatatcaaaaagcttatccaccaagatcaagttggtttcatccctgggatgcaaggctggttcaacatatgcaaatcaataaaagtaaaccatcacataaacagaaccaatgataaaaactacatgattatctcaatagatgcagaggaggcctttgacaaaattcaacaacacttcatgctaaaaactctcaataaactaggtattgatggattgtatctcaaaataataagaactgcttatgacaagcccacagccagtatcatactgaatgggcaaaaaaatggaagcattccctttgaaaactggcacaagacagggatgccgtctttcaccattcctattcaacatagtgttggaagttcaggccggggcaatcaggcaagagaaagaaataaagcgtattcaattaggaaaagaggaagtcaaattgtccctgtttgcagaagacatgatggtatatttagaaaaccccatcgtctcagcccaaaatctccttaagctgataagcaactttagcaaagtctcaggatacaaaatcaatgtgcaaaaatcacaagcattcttatacaccaacaacagacaaacagagagccaaatcatgaatgaactcccattcacaattgctacaaagagaataaaatacctaggaatccaacttacaaaggatgtgaaggacctcttcaaggagaactacaaaccactgctcaatgaaataaaggaggacacaaacaaatggaaaaacattccatgctcatggataggaagaatcaaaatcgtgaatatggccatactgtccaaggtaatttctaggttcaatgccatccccatgaagctaccaatggctttcttcacagaattagaaaaaactactttgaagttcatatggaaccaaaaaagagcccgcattgccaagtcaatcctaagccaaaagagcaaagctggaggcatcatgctacctgacttcaaactatactacaaggctacagtaaccaaaacagaatggtactggtaccaaaacagacatatagaccaatggaacagaacagagccctcagaaataacaccacacttctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaactataaaaaccctagaagaaaacttaggcaataccattcaggacataggcatgggcaaggacttcatgtctaaaacaccaaaagcaatggcaacaaaagctaaaattgacaaatgggatctaattaaactaaagagcttctgcacagcaacagaatcgaccatcagagtgaacaggcaacctacagaatgggagaaaatttttgcaatctacccatctgacaaagggctagtgtccagaatctacaaagaacttaaacaaatttataagaaaaaatcaaacaaccccatcaaaaagtgggcaaaggatatgaacagatacttctcaaaagaagacatttatgcagccagcagacacatgaaaaaatgctcatcatcactggtcatcagagaaatggaaatcaaaatcacaatgagatagcatctcataccagttagaatggggatcattaaaaagtcaggaaacaacaggtgctggataggatgtagagaaataggaatgcttttacactgttggggggactgtaaactagttcaaccattgtggaagacagtgtggcgattcctcaaggatcgagaactagaaataccatttgaaccagccatcccattactgggtatatacccaaagtattataaatcatgctactataaagagtcatgcacacatatatttgttgtggcactattcacaatagcaaagacttggaaccagcccaaatgtccatcaatgatagactggattaagaaaatgggcacatatatacactatggaatactatgcagccataaaaaaggatgagttcatgccctttgtagggacatggatgaagctggaaaccatcattctgagcaaactatcgcaaggacagaaaaccaaacactgcagtttctcgctcataggtgggaactgaacaatgagaacagttggacacagggtgtggaacatcacacactggggcctgttgtggggtggggggatgggggagggataacattaggagaaatacctaatgtaaatgatgagttaatgggtgcagcaaaccaacatggcacatgtatacatgtgtaacaaacctgcatgttgtgcaaatgtacactagaatttaaagtataataaaaaaattggaaatttgtgtgggagaaataactattgggatttaatgtcaaaggtacaatatttacacataaaaagttttattatgggtactatattgcatagcataagtgtgttttcttattttatacatatataccaaatatatattatatatttgaagggataatgtgtatattatagatcacattttatattctgccacatacgaccataattgaagtaataaatacctttaaaataaccgattattgcaagttttaaggcaggaagtctgagaacataatagaagattagagataaaatatgcacttatttccattctaatctatattattgttttaaaatatttttagatgtatgtgacaaagatattctaatattacctaattataaaacacataattaggctgtatttactatcatttttgtcatttaggtatcaaaggtcatttaagaatttgtcatgagaaactgccttttgtttttagacttacagtaatgcttaaatattatttccccaacatcttctatatctcaaacttggtggcatactttgcaggccatagtaagagactgtgacaaccatcctttccaatactcattactaagaaaataatacaatttaatctgactatacctattaggatgcaaaaaatgccagtaatctcaaaaataattagatgcaataaattatggcaaaatccctaacatttcagctttgcagttgtagaaaaatgtgccagttcagttgcatttaaaatatttaatttgatccctaaaactgaaatagttgttgccattcttattgcacttacggtaaaatgtttgctttatgtaaaacctaatgggtaaactagacgataagatttaatcatattttgttttttagccataattctaggagttcatctgagaaactcagggatgaaatgagattcttagatcattaagttgcctcctccatacttgtatatgaattgtgtaaattactttattttgctcgagttttttttttattatcgcaatgggcaacaggtgaaacataaatacaccttcccatgggtgtttctaactctgatgtgaagaaatcaacggggaaacagaaacatgctctggttaatataattaaatggagcttattgtaagtatatactgaagatatgaggatataaaaattaaaactttcccaacaggtttgttgaaatttagaaaataattcacagtcaattagaggacatacagattagtagactaaaagcagttctgattatttaacagtgaattttctaattttctatacttgaaatcatgactgcagaaagtcattgccttttaatctgccaggtgttacctggattcagatactagttcaaagatttaccaattgtgtaaacttcatgaggttatttaatccatctatacttcagttaccacatttagaataacaggactgaatttatggagttgttttaaggtgtgttgattatctattgttttgtaacaaattgccacaagtttagctggttaaaacaagatacaattattatagttcctgtaagtcaagagtctagcacagtttatcaagatctgctcagggtttcacaaggcaattgttttggctgcattccttttggagctcagagctctctttgaagctccatgtgatggttagctgaattcagtgtcttgttttgtgtgactggtgttcctattttcttgctggctaccatcctggagctgctctcagctacaaaaaacatcctataattccctgccatgaagccttgtcaggccatctcacgggtcttctattaataagacaacttgcctcttcaggaccagctggagactgtcttattcctgtctgcaaaatggaatcttatataagctaaaatagtcacgacagtgatttccatattctttaccatattctcttgactagcagcaagtcataggttcagccttcatgaaaagaaggagattatgtaaacatgtgactcattggtggtcagctcagggtgtgtcccacacacaaagattaaatcaagaaatccaggtaaaacatttataatcctgttggcataaacacatcctcagtaattgtagctcttacgtcttactgagctttttacttagaaaaattttctagtatctttgtgcctcctattgctttatgaattcagttgcttccactgttaggtcatcttacaagtttccttatagtattttctctctttctttttctgcaccactgatcacaggctctgtctttatgcatctaaactgccaagttagtgatgtgattctccggtttttgcattgtcagaaagtcaaatgccaattttataacctcatgaaggtgaagaaccagtcagattctttggttgctggggtaagaaaagttaattaaacctgtgaccattctcaaacaagtgagggcataaattccagctgatgttggcctgttcagttagtgcaataaggtctcagtcacacatcaattacatagtatagaaacagtactagcaccattattagcagatattaatgtaggccaggtgtattgtgggtgagtgcccgaatgcttctcctcagtgtttcataagtagaattatgtctcattctctcctgaaatccaatataatcatgtgtcacataattatgtttcagtaaaaaatggaccagatataccatggtagttccataagattataataccacatttttactgtaccttttctatatacattgtgtgtgtgtgtgtgtgtgtgtgtatgtatgttaagataggatcttgcacttttgcccaggctggagttccacggtggtgcaatcatagctcactgcaaccttgaactcctgggctccagggatgctcccaccttggtctcctgagtagctaggactactcagcatgcaaccatgttcaggtaattttttttttttgtaatttttagtagagatgagtttccactctttccaaggctggtcttgaactcctgggctcaagagatcttcctgcattggcctcccagtgtgctgagattacaggagtgagccaccataccctgttccttttctatatttagatatgtgtagatacaaaaatacttgccattgtgttacaattgcctacagtattcagtacagtaacgtgctgcacaggtttgtagcctaggagcaataggctaaaccatatagccttggtgtgtagcaggctagtactagtagaccagctagctttgtgtaattgtactctataatgtttgcatgaggacattgcctaaggacaaatttctgagaatctaacccctttattaagcaacacgtgactgtactgaaatacacttcttggcttgtgtttttgtagagtcaccttattaactcattagcttttttaaaattataaaccttccacagtaatgattatatccccagtaagttccctcaaaatatcttactactgtgtcaatagtactctaggatgtttgtgctctattcaaattcacattttgaagttcgatctacctatatgttagtatttggagactgggctttggggatgtagttaggataagatgaggtcataaaggcagggccatcatgatgggattagtacctttataagaaaagaaaccagagcttgctttttctctctatgcttttcatatattattgtcatcaaataattcaaatatccaaggggttaactggattgggaaagatattttcaggtaagtaaatgacactttttcacagagagaaattttcatgttgtttaacaactgaataacctttataaaataatatattgcttttagcaagtagactgaattgctaatttgtgactttattgtcaatcttgtgtaaatttggcagttgttttatatattttaaagagtactagagattatccttttaaattatcaaagtaaatcatttacatggtcaatattataaaaatatttatttcacacttatttgctgtaccctataataattccataattacatctttatcagcatatttcaacatagtaatttgtttgtattaagtgttggtcattattaagggtatttccttcccagacatatcctgttttttgtcccctgtagcaagtagaaggaggattatacatcacctttagagcttatattccaaatttttctggagtcatagccactgactgattataacaggacaattctgtacagaaatgagttccaaagtagcattcattgattacagtttttgattcccatgggcaatagcctctaatcttctactatctggagcattcctactgattatatattgaacataaatatttgttcatggtaataagcagttaggaagctgtgctataagctacattttcattttatatattcaggtactctgagttgcatatctttttcacaactttttaaaattttagcttggtattctaggatttcagactacacaattctgattccatttcaattaatgtaacaaaattctctccctgagtgaatacccaggattattttaatgtttgagttttagcctagtagccaaatatgttaaggttataatcaggccagatttataaagcttctcctccactttctggaattcctgtccttaactttatttctgaagtaaaaactgttccagtgcttctctttgacttaggaggatattctcacttcccactacttcgtttcaaatatgctaggtataacttgttaaagctcctcaggccagttaaaatggcaccgagatttcatttcctatgattatcgagtcaatgcattttaaatctcatttttcccataaatcatattaactcagaacctcttcaaaatatttcaatcagtagcacttccttcttcaggagaagacagatcatacccacgttatctacatacatcttagtctgataggactgtacaaattttcatatttcctctaactatatcatgaggctttagataatgcattctttttatgtacagctatttttgctgaaaccaaattactcagacattttatactatttgtgcatgattattttaatacttcagagaacatggccaagcagcatgtagttagaccctgtacgcagacttcctccttgttaaattgttttgtgccctctttgtctttaaaaattattgtattaattttatccgtaaacaatttacctgttaatttttatctaacaaaaaaatcaaatgttggacttactgcatataatatggcagaaattaaatctctaagggaactagaactgtgttcttagtacatgtagtagacttattctttgccccctaatatcttcctgaaaataccagttcaatttaattgcttttgaggagctttgttgagcaggcactttcctatgagaaaggcttttagacattaccctggacagctgaccacaaagtgataactcagcacatctagaggccctgttatggactgaatgtctgtgctctattcaaattcacattttgaagttctatctacctatatggtagtatttggaaattgggctttggggatgtaattaggataagatgaggtaataaatatgggaccttcatgatgggattagtacctttataagaaaagaaaccagagcttgcttttattctctatgctttttatatattattgtaatcaatagccacaattctctgagttaagtaaaatttgggtctccatgtttcagataaaagaactgccaagtttaatttacttgtgccaggtaacagctctgtaagactagtgactgatatacaagaaatctgactatagaagccaaaggtgagcatgaacaatattttattataaataaatactctgaccatattaatttttcctcaaacagctgtgtactatgaaactctgctttcttctcaggcctggaacccattatccattttatttctgcactgctgtgaaacttttataatagcattcattacatggaattcaattattggtttctatttcaagttcttcatagtaaacttgagagccctaatatctttccattatagtgcaatatgatgtaaaaaatgtcattttaaaaaataatatttctatctattggttttgcagatataaatattatcttgaaaaataacaatttgaaaatctcaataatcactttggccctttttatactcagtttaaattccagcctcttcaccttttgggacactctgctctctgttgcacaatgtcatttaccaaaattattttgctttaccttgggcacaatgatatttttgtttcttgtaaaaatccatctgataatgaagatacatttcaaaacaaagtagacttatttgtctctgtgtattgatttacattttacatcaggcaatctattctttattttaatactaattctatttcatcacaaattctcaaacagtcatctgaagtagtctatcaataagagaactttgtataagtattttctattattggtttttgggacattcttaatgaacataaaaaatatatattttgcctgaattacaaggtaaatttaggtgaaacaaaaagtgaggaaatgcaaagtcaacctatcaaatatttagaagaatacaaatggaggcagccagaaccataagaaaaaatacatttatttgattttataaaataaaatattaaaaagtgtctaagttctttgattgccaagaatagtttatgcctatattagttgaagttgagcaaaattatcattttacaattatctggcataatggttgctcataatgtatcttatgtgtcagataaaatctcccaataggaatggagaaaatcatttaaatgctgtataatagatatccaatagctgttgatattttcaatgatttaactttagttttgattggaatcaacaactcaaacctcccaaatctgaaacagaaaatttagcaacatcaagattataaggtttctttgattactttcctcctctgattggcttcctgtgctggctacttaatcagctagtaacaggcccaatcagatataaatttcctaaacttctaaattatgaaacatcatatatatatagttacacttattttttcaaataaatttgattttaaactaacccatacttatttatgctcaattttgtttcattttctaattattcaaaaagaagacttttaacaaattaatataaacataaacctcacattgcaccccataaatatatctaagaagaaatattttagaataaaaacaagttagcatattaattaaaaagatagctttacccaccatatataagtattttacattctaggaggactgttttgaataaccactactgtattcactatttattctcaacttaaatgctacaatagtatagtttgctatggtaataagtacttgagttattttgattgaataaagtttagatagaaatatgtcaaatttttaaaagcagaactcctaatacaaatggaaagttatttcaacctgtccataagttttaagaattctgtgggatcggtggtgatatcccctttatcattttttattgcatctatttgattcttctctcttttcttctttattagtcttgctagtggtctatcaatttagttgatcctttcaaaaaaccagctcctggattcgttaattttttgaagggttttttgagtctctatttccttcagttctactctgattttagttatttcttgccttctgctagcttttgaatgtgtttgctcttgcttttctagttcttttaattgtgatgttagggtgtcaattttggatctttcctgctttctcttgtgggcattcagtgctataaatttccttctacacactgctttgaatgtgtcccagagattctggtatgttgtgtctttgttctcgttggtttcaaagaacacctttatttctgccttcatttcgttatgtacccagtagtcattcagaagcaggttgttcagtttccatgtagttgagcggttttgagtgagtttcttaatcctaagttctagtttgattgcactgtgatctgagagacagtttgttataatttctgttcttgtacatttgctgaggagagctttacttccaagtatgtggtcaattttggaatacgtgtggtgtggtgcggaaaaaaatgtatgtttattgcggcactattcacaatagcaaagacttggaaccaacccaaatgtccaacaatgatagactggattaagaaaatgtggcacttatacaccatggaatactatgcagccataaaaaatgatgagttcatgtcctttgtagggacatggatgaaattggaaataatcattctcagtaaactattgcaagaacaaaaaaccaaacaccacatattctcactcataggtgggaattgaacaatgacaacacatggacacaggaaggggaacattacactctggggactgttgtggggtggggggagaggggagggatagctttaggagatatacctaatgctaaatgaccagttaatgggtgcagcacaccagcatggcacatgtatacatatgtaactaatctgcacattgtgcacatgtaccctaaaacttaaagtataataataataaaataaaaaaataaaaataaaaataaaagaattctaaggagaggtactgatccctgataagaatgaatgtggagagaaggtgacggtgccgattttgattgcttttctccagcttactgaacaaacagactgaagaattactgcagagatatataggcaactatgtttagctgaaataggattgtgtgataacagcaaattaacagagaacatctgatgaaagcaaaggaaaacataacctccgcaaaaaaggagtataatatacaattcaaatatagtcctgattgggaaggaacattagtatttaactaaagatatatcattaagtgaaataatgtatggagaaagaaacatgccaattgttctataaatgctcatgtttgcttggaaatatattacctgtttttcctaagaaataattttgataaagtgttatgtattcatttagtaaaatattttgtcaataggaccatgtttgagtcaggaggaccatatcttattttacatgctacttaaaaatgcaagaacgaaataggaatgacaaatagaaagagagtgtgtagttgtggcattattgttcctacaaattggaggagtaattgatatggagataagaaggaattaatgctgtgaacaaagactgagattatatagacaagaatttgagatacgtataaaaacacatttgttcaacctattagctaaataatatcttggaagtttctctctcttgccatttatcctgctaatatgttcctgatcagtttaaatgaccaagtgtgcataaatctacatggcttttcattcttttccattggcaacacttcatggaaagaaactctacaggagagggttagaacaagttatgaacaagttaggagaattcataatccatcaatattgaaatatttttggtaagtataacataatagaataccctgtgttatgttatacatgatagaatactattattaatgttgctaagtaaagggcttcaagctccagcatttgccaaaagactgagaggagtttgcaaattaaatttgaattaatggtgtcctggcaggagcatgtaaaggagtcacgagactaggttatgccagatactaaaaatttgacattagagaaatcattcaaactcattggacattcacctgtaaggttttgtctttatttctttcattttcctaattagattacattgctcattatattaacatgttttgagaatatatatttttatgtttttcataaaacattttatatgtatatatatattttatatgtatatctatgtgataccacatatacattaggaaacctataataaaaaagacagaagataagttttgatgaggatatggcaaaaatgaaaccttcgtacatgatttcggggatgtaaaatgatgtaactgcttagaaaaatgccttaacagtcttcaaaaaattaaacttagagttaccatagtacctagcaattccactgttaggcatatacttttctgagtctgttctgtgctgttacagcagaatactatatactaggtaatttataaagaaaataaaatcatctcacggtggaaggcaggagggcaagagagctcgagaaatagcaagggagatagagatggccaaactcgcttttataacaagcccactgctgtgataatgaacccacaataacagcattaatttattcatgagggcagagccgccatgacctatacacctgccgttaggtcccacttctcaacactattgcactggggattaggattccaacatatgaaatttgggggacacattcaaatcatagcaatgctcaaaataattgaaaacatatgcaaacacaaaacattttcatgaatagccataaccacattgttcataatagcccaaagtggaaatagactgaatattcattaattgatacacaataaacaaaatgtgacatacccactcataggagtaatattgatctataaaaatgaacgaaatactgactcatgctacaacataggtgaatcttgaaatcattatactaaatgaaacaagctacacacaaaaggctaatcattttatgattatatttttatgaagtgtccaaaatagacaaattcatagaaacagaaagtaggtttacaaggaggcctggaggggaaaatgagatgtgacttctaatgggtatctggtttcttttgggttaatgaagatattctggaattagagtgattattgtaaaactatatgaatatgtgataatacactaaattgtatactttaaaaggtgaatttgttgttttgtgaattaatctcaataggcataaagtgattattgtaaaacttttatgaatatagtaaaatacactaaattgtatactttaaaaggtgaatttgttgttttgtgaattaatctcaataagaataataaaatttaatacattataggtggaatttaaggttaactgtaaaaaataattcaggttctacatttttatagttttatttatgaattttgactagagaaagttaacttagaacaacaaatttactatttcttaagctttttataatcactttgattatattagaattataatgctttattaattaacatagactgtgtgtgaatggaaaataatttcaagtttggaaaaagatacaactgacaaagagtttatattcacaatacactaaagctcacttaaatcaataagaataaactaagaatcttacttaaaattgataaacagactcgaacaggaattctcaaagaggatattcaaatgtcagatatattttaaaatggtcagtcacattagaaaatgctcatttatccttagcaagttaagatgaaaactatgtattattgcaaacaaatcagaataaatagaattttaagaatagtaataacaagtgttggcaacaatgtaaggtattagtatatccaccatattgctgatggaagttcaaatttgtataattgtattagaaaactcttaggcattatctactaaaaatagacatatacataccctgtaacctagcaattctacccgaagtatcaacgagccaaatgcaaaatgcctgtatgtatacaagaagcttcattgcattgctgttttagcccaaagtccatcaattgtagactgacgaatagatcaacgaatagattatattagattttcatcaacaatgaaaatatatgaatagcatataaaaataaaatttaattttatctatataatgtaaccagacatgttattaatttaattaaaaatacatgcaaacctaatatatggtataaaaagtcacgattttgatgaagtttaggaagacaagagcatttatttactagaagagaacataggaacttctaacatgctggtaatgttctatattttgagttaggtacggttacgtaaccactgagcagacccattgtgatttctgcattcttttgtatgttgtgcttccatgcaaatgttatttaaaatttaagttaacaacttatatacatatgtgatctcatatatatgaatacttctgtacaaaatcatatctatatattatttataaatacattatatttaaaatagtctgtgttcatagctgaaaaatgcattacatgtatatgatgtaaaaaatatagcatttataaataccaagaaaaagttctaattgaatgaaacacaacctttagcagtgcatatttctgggtattggcctgggatggaagaggctagcagggacactcagtatttccttctgaaaaattaaaattttattctactgagatcactcatgtattacatatatgaattttaatacaaaatgataagcaacattaaatacattttttctcattaatgttttcagaattataaaatttaaatcatctcagtatagcgtgggaccattacagaagaaatgctcggtggtaaaaatcagtcacctgtgtcaaggcattttcagacagggaacaatatttagcaagcaataaagtacaatcttggcaataatttctatccctatactctacactttcttaaatctgcaaagtttaaaatcttagcaagtttttaaggtattcagggcagtggaattatgtggaagcatttctctcataaatctgttttaaaattttacaattcaatattttatgatcctatgccaaatctatatggcagatactttctacatttcattcttcttgacagcagtggccttttacccttgttttcaaaagtagaatgtaaccacaccaggaaattaaaaacagcattatttagtgagattctagttattatttttctactcaatataggtaatgcctatgcttaacatgctccttggcactattctgtaattattgaagtttcccaccccctgtaaaataaaagaatacttttaattaatctatatattcagtattgttccaatcagttttatttaaagcaaaatgaataaaaatattttttcaaagtctcaagtgataaatttagaagcaagactgaaggaggaaagaagtatttcttttcattgagtgcagcatatttctaagatttgtctgtaaaataattggaataatagaaaaaatccatcaagtctgtcaaaatgacagcaaatttggaaaaaagtgaggatgggcaacatttatataaaatctattagcgaagcagcattggttagaaaggtggtaaaatggctatggttaaagaccaggataagtggcttttcttctatacaaattattgtttttgagttctttcatattgccaagcataaaaattcacctaatttattcaataaatattcattgaacatatactgtattctagatacaaaataaagtgttgtgaaaataagatgtataatgttgtatggctgcttgtattatgagaacatgattgtgaaacttagtttctttgagatttcaaaaatccagaaacactattataattcaagctgagtatagactacaagttctctagagaaaagaaaatctaagttgatcatattatttcaatgtattctgtctaggaaatgtcacattttatgcggccctggctattttattttctactttatttttctctctgtaaatattttcttgtgttcacttctgttacaagttcacttctgtctaaagcctcattttagtatatggccaaaatggttacatgtttctctcataccagtgtgtacactcttcacaatatgactcctgcaatcaagaggaatttatatctctatgtctcaaatttatttatgtattgttttattttattttaactgacatataataattgcatatatgtatggggtagaatattatgttttgatacatgtatgtattgtggaatgatcaagccaggctaaatttagtttgtaccgtgcaaattggtttggccaaagtgacattagccaaggtgacacagcagaggctttcaaagtggttgctcatcagtgcttggccagtcttgctgttgacaacgttggactatcacgtaatgaagcccaaaacagcctcatggaagatgagagacatggaaacatcggcccaactgagctaagcttctcacctgttccaagagagactggtcccctgctgacctacaagctgactgcagtcccatgagttatcccacatgagagcagagagaaaatatacagccactcaaagaatcatgaggaattatatattgttcttgttttgagtcattaaatttggcgtggattttatgcagaaaaaaatacaattactttgattattgcatgtatcatcaattagggtttttcttttgcattcaaaataaatctaacctaagccaaacttgctcaagaagttagaaaatattttgcttcacctaagtctgaaatctagagacacagtttcaggtgtttatgtaaattgatcaaggtttcaaatgatactgatgaagagagcctgatttttctcttttctcagttctgcactctgtcattatatattacttttgaattaaatcattgcctgtcttaaaatgggtgtatttttatgattcctaggaaattcttcttgggttttattgacctcaaatacactaattgtctttactctagatcacatgttacaattcttagctggcttactgcccccatctgatatataaaattactcagaatgataacaagtattttgtggaatgaagggcgactaaattctacatgtcaagaacaccaggtattcactatatgataagttagttgactccctaatgaacgtttatcagcattatgataaactacatgagtatctgaattttagtgtcattttctcccagaagtcttcctaattccctgtaccaggtttagggcctcaagttatatgttcctgtttcttttaacgtttgtttgtttaaataaacttagtcaattgtttttcgtccattgccagtagacccatgagggcaaaggacatatttttcttgtttactattgtgacttcagggtctagcaatgtgattgccaaataaatccttattcaatgaataaagagtaaatttaactgtttccaaatttcaggctctgttgaacacaagaaggttcaatctaggtttatgtttagggttatttattcaattatttgtattatattaaaagatgtaaatttagtctagaaacataaaggccataagttattgtggagaaaaaatattgttttgaatccaacactgttgttgagtattcatttgcatactctaattacctaccaacttcacttgacaatgttaatattttaatgttataattcacataattttgatgtggttttgttgtcagaaaatatggtgagcatattcatctgttgaaacctagtctacaatgtaatattatttggtgatggggcctttgggaggttattagagtaagattaggtcatgagggtggggctttcatggtgaaattaatacccttgtgaaaaagaggaggagtcacaagatctgtatatcgcattcccagtgtagacaccaaggaaaggctatgtgagaaaataatgagaagatagacatctaccaaccaggaagagagccctcaccaaaaattgaaattcactgagggagttgaatagataggcaccttgatcttgaacgtcccggactcctgaactgtgataaataagtgcttgccgtttaagccacccagtttatggtattttgtcatagcagctagaactggctaagacagcattttaatctaattatgatcatattgtagtgtacaaggtaaattgtttatataattgttagactagttttggtagtgatgaatgtcactcctcaaaattcgtatgtaattgcaagtaatactaatttcttgtgttttaaaattgttctctctatagatttttttcctatgtatactctgaaattggagttcttaatttcaatgcatttttgttgtttgtttattttaatccattataacaattttatttaggggcttcatatagtaagccctgctatatttattcaggaatttaaacacatgtaattttgtttcaatgattatagtaataacaataggtgattttttccagatttctgtttgctctcatatattaatatttacacctaagcattttttgagaacctacaaaagtgttacttcttccaaaaacctctgtacttcagaccactctgaatgcccttccctgaatctataagcttcagggaatttcattattataatagttttgtacccattgaaatgatctatatacaggttcttttcattcagtaggctataagctccttgatgagtgaggcaaaatattgttgagctttttatttctagttattaacacaggatctttaatgtagtagatgtttaaggaatactttgaactcgatcagctttaggtattagacaataatttctaatttataatataagaaataatttaaaatcttaatagaataaggattatgcagagacacagatatacgttctttatgcagatataaaagccaaatattattctgttataagaagagagtaaagcaggtcgatgctgttgtaagcccacttgacaacatgtactttttatataaaactaagttgggtgtttttaagcttatccctggccaagagccagattgaaggaaaatgtaccatttaactgaagatatggtcttatttaaatctaaaggccgttattttatgtattcttttaaaactttgaacccaaaatcctgtaaaatatcaagatcttaataatatatctgtagggtattgataatttgcaacatcaaaacttctgctgagtagattttgagtcatatatttaaaatacctatactattttataaattagaacatttaaaacatttgaaaatattaaaaatgttaaaaagaatttcaaagtcagtaggacaacccttgctagacttcccctcctgcaatgcaccatcagtctggaaaattgaaaaaagtcaaggtttgctaaatagctgttgcagaacacaattcttaattaagtcatgcttttggagttataaactttaatatactttttcatggcattctatattttacaatagctgctcctctcagaatatatatcctctgacaacattgggcatattagtcactaatacatagcttcatatttggaaaaagaaaaaaattataaggaaaatctccacatatcctacaacaaagagttacatcagagagcatgttaatactcataataagcttagagttctaccaagtatatttcttatgtgccttcaaacatagttgtgcttctgcatcagtagaatattatgctagaaactctgttatgggctcaaagaggaaccccattattacaaaaggagttctataggtaaagctagcatattgcaatgtaaccctgtctacagcgccagaaatgtgtattgagagctccattaggtgcacaggaacacagcagtgacacatttaaataccaagtgctgcagaaaagtgccactagcttttccaagggactgaaattgggcagcccagatttaaactgtggttttaatttgacttatgattctcttgccctctagtgggtctagaagttgaaaatagatgtctgtattactatatattatctgtgattcttgtagagattgaactggagaagaaaaatccttagacttcagtccctgcaaagccctcattgacttaagaggaatttatcaatgtaaagggattggtttattactgctttaaacccctcatgtatcacaaagggatttgctaaatactttcatagggactgctgtgtgttgccaaggggcttcagaaaagcactgaaccttttggtgattgaaatgtacagtcctgctgcaatgaagtaacataattggaatcaggactagatgtttttataggagctgattatgtgcagttccaaaagtatcattactttagcctgtcttatccttgagggcataagaacacttaaaaaagggctttaaatatgatggctgctcagtaggtgagcaagtctttggtgagaggtgcattagctataatttataaagtgtagttggtggcatttaacgttctaattatatgtaataagatacgttaaatggtaatatattgtgtgtgctatccaccttttacaaaagttctaatccatttatactactgtgatctattagagaagcacagattcttcttcatggtatattaaccatatgaaatattagggtaattgaagcctgaatccaagtaattataaatctatttattgaaaaaaatcattgatatgcctggcatgaacaaacagctaaatatgtcaggtagccacagagcagcaagtgatataaattttaaaatccaacaatttaagtttcaaattagaagttttgtcattaatgttctcataaaattatattgtgttaaagatctgtgtaatacctaactccattaatattttgagtattattttttaattggcaatctagaattcatgttaaatatgagtttgcttattaattacaagtaaatacaataactaaaaaataaaattctgctatgacctaatgatcacttttcttccccacaagatgcctaacattgaaaacttttgaaaatagcccataaatgaatctttctagcgtagcttccaacaattgtattttctaataatatcacttttttaaaaaaggtggatgggtgattaaaataaatgaaatcactggatttcatttagactaacactgtaatctatgagtagatgaatgcttacttatgaaacaggatgttaaaacaggctaataatttatattcatagacaactgtgagaattacagaaaatatgttaaggattatttttaattagaaacaataaatcaagtcaaatttacaagatattgtctatttgagactgtgacgtaatgactgggtgaaaacatctgaagatatgctttttacagacaccaaaccagaccagtctctgtttgaagacatacatgattacttttgaaatatttttagatggtcataacttcataataagtagtttttttgcaacttacttgcattgcttatgtttatagcaaccactatgtcctcctccagaacattatctttcaaacttgaaataatcataatcataattaatataatgacaatggatgtaggagaaatacaaacctaatttttattctcaatgatgattatggatagaataactaaacccacatgtgtattacctttccccatagacatattttacactttggacacctaaagtccagctaaaaagaagtaattgcctacgtcccctatgacggaaatccaaaatatataataaatgcatttagctcatgaacgatttttaaatttctgtttgatttgttgctggagatctcagttactctctttcttgttaacacatccacacccaacctccaatacagctgtttacatgaagcaagagattgggaagcctgagaatgaatacctgattctagctgggcaaataattttgtgtttctttgaggagtttggaatgctgatagactgaattaggtaggcataaacaacagtttcaagtgtccatatatttggcactattgttgctgacaatgacagcttaaacaatggtcaaatgaaaattgtgaaaaacaaaaaaatgaaataccacgcctaagtagccactcttcagagaggaaaatttaaatgcatagagagatgaaaaatcttgcagccctgcaaataaatgaaggtgctctgcaaatgtacatttctaatgtggccacattatattccttgtaattaattccttcatattttttattcctatttcacttaaactcatttgaatgggcattattttataataaaaacatccttgattatgattctgtattaacaaagataatcataccaaaatttgtcatttttttagtactcacaacagaattattcttttctagagaaattaaagctataggggctttttactttcaacattattaaactaatattttgttttaattttaaatgagaagttaattgatattttgcttgtggagtatgctgtagaattattttagatacaataaactattatgatgtttaattttgtcatttgcaatataattatattcatttgtatcattgagttttcagtgtagtcagattaagtaatacagaagtttatttctctcacatacaattttccaagtagacaagtggtccagggcagctgtatttcatgtctttatctggatactcaggttggcaataacttccgctcacctcaaaaagctttttttctactgtttgtccaatgtagtagttacaaaactgtccattccacaaccagtagaaaggaataaaggggaaattaatgacagagctttattctatggaaatatcatgaaggtgcatgcatgccatctgctcatattgctatagtagggctttatccgaatgctcatacctagctgtataaggagtttttttagctttagccttcagacctgctaaaatttggatgtggacggtttattagtaaaaggaaaaaagacataactattggtgagaaattagaatctctgccaatgaacaatcctctcacttattttgtatgtatctttcttgtataacaatagtaatacttagaaatcataggttgatggaggtagagactttgtcaattatcaatggaatgagttttcactcatttaaagattctattcaggatatatatatatgcataaaacttatttggaagaagaaatatattttaatacaacaaaatatgtagtattaaataaaattaaatgtggattaaattaaatatcaattttaaaggacatttttctcattacaaagtttttcttattagaaataacttattagaaatattgcaagtgctaataagaaattgaataagaaatgtggtttcagaagggaaaaataaaaacaagcaaatgttacacaaagtagaatacattgccatttttgccataacgttctaagaaaaattgtgatgaggtaagaaagcactaaacaaaaaagtctatattcttaaaatcactacacttccacaattttaatcactgatgaacaagccttatggcttaggagaaactggagaaagtaaaaatgaaaaggtgtttcatggattagaaaggtattgaccttttgattctccgtttaatttacactgattgcatcagacaaggagggtaaagtctacaaattatagctaatgtgagaaagttagaaataacttaatatagaagttagaaactaatagaaaataagtttgtggggtttttttttttcctgacaacaatcgaaatcagctttcttatcaaagtggtagaaaaatagaatgatataaaaggcattaatatagggaaacatgcacgatcagcaaccacgtcttctttcattccaagaaaaagttttacttcaaaacatcagaggtttaaaagaaaaatcaaattttctatgtggattttcgggacaatatccaaccagaattacctcttcaagttagtgtgtttaatatccattcaacctggcctctttatggaatctttctttagtttagctgtaagaaaataggcttagaatcaaaagtcccagaatctcaacaaacaatgtcatagttatatgatttagggcaaggccttcttttccctgtacctttttttttttttctcttaaagttatatatgaaaactctttgaatttttctctgggacgcttattaaagaaactgcatcatattgctgttgtgtattgcggtgaagataggaaaatgcgggggataaacaggaagcatctttcaagatcatcaattactagaactttttgtggaaggaaggaccattattgatatatgaaaataaataaattatagaacatgagtaaaaatttgcattaaggtgaggtaataaatatgtgattgtgttcatttttgaatcttttgctcttgacttatacgtgtcttgaatactatgcagttctttttttttatactttaagttctagggtacatgtgcacagcatgcaggtttgttgcataggtatatatgtgccatgttggtttgctgcacccatcagctagtcatttacattcagtatttctctaatgttgtccctccccctgtcccccagcccccaatcggcccgggtgtgtgatgttccctgccctgttgtggaaggcagtgtggtaattcctcaaggatctagaacaagaaatactatgcggttcttaattgcttcttttccctgttccccttcaactccattcaactctgaaaactttgttgaataatgtgtgtttcactgtacatttcatgcatagagaaaagtcactggacactacaagtattttgatatttctttttgccttctaattttctccctcatcaatgtatttcaccagcactcagtcctgggctttcttatcattctttcctttacacaaatactatgcaacacaatttagctttatttccacaacttgaatgccatattcaatgaaaaaaaattttatttgtccagccaaatgtattttttgtctattattcctcaagcatgctgccactgaagtaaaagaatgtatggctcagttcatcctaatacaaaatattacataacctgcttttaataaactatgtatgcttacattctccctctgcatttaaaaagattggctattagaacaaatcctagaaccatgcttcttcgtttcaaatcctgtctgtcacttatcattacacagtggagtaaaataagtgtcccctgttattactggtacttgaattaaaaagttttagaagcagagaatggcagaaaagctcacacgaggagggttgaatttgaattctgggtctgatgctcacgagttgtgtgagttggttgagtttgcctgataagtttatctagaatccatactgatgggacaggcaaatcattactttgcctgataagtttatcaaattaattgactatcaaattaattaattatcaaattaattgactttctcataagtagagcttcagtaaaggcttaggactacatttgaaattatgttattttttaaaatttaagctgcctaaaaatatgttagaaaaatttagtaccatagtaaaaagtaataattgatctttccgtggtaaatcatagcatattatgttactgataaatttatttgtgtatgtatatatgtatatatacttttggaaataagttgaaagagtatttcaacatgaagaaaatgagtatatttaacaataaaaacattttgaaaaaaacaagtatacacctaatttgtgtattttagagggtttatgatcaatatcaaaaaatggtaaatcagcttgtcaacaaagaagagatactggagacatggtaggctaacaagtatgactccacttctcaaacccctatgctttatttctgaatcaatattcttggctgactcagaaaatgtattaaaacaatccatatgaggaccaggtttctgaactggaatatttcaaacatgtgtgctggaacttttcacagcatttaccatttccttgatttactctccaaaattgatataacagttgcagaaaacatcttaaggagtacactgagtgtgaaaaatgcttcgtgagctggaaatattctgaaaccttgtgttttttttgtggagtaatagaacacaaacatcttttggtactaagataaatatgctctcagccaagtgtgtctttgcttttgaaatctgatacctgagaatttaactaacacatttctaattaattgacttcctcataaatagagcttcagtagaggtttaggattacatttgaaattatgtttttcttaatttttgtttaaatttagctacttgaaatatgttcaaacattttgattctaacaattttgaaagcccataataccagaaatgtcacttacatgggtataagaactatgtgtgcattttgtttatatgtgaattgacttctaagaagaatcacatcaaccaacttttgcatcctaaaagtgagaagcagaaagttagaattcacttgccatatcttccattatattctaatttcaaaaaattaccagaaaagagggcaagcaaatattaaataaaagcaaaatctggcatacaagtcagtaagtggaaaagtctaaaaggaatctgtaagaaaaaacatataaagctttgagtgaaaacaatgtaagtggggcaaaaagtaatgggctttttcttgtatcataattcttatgctgaaatccttcattatagaatgtcctcatgaccatagggagaaatgctctttcttcagtaggatatatttaaaaagaggaagtaaagaagggaatgaaagaagtaaaaaaggccttaagagccttagatagcactctcaagaatttaacttcagattatagaaaaaaagaaatacaggaaaattagaaaagtaaaagcagaaattaggtgataagaaaaccggataactatagcattcaaaagtaacagtgttttatttcattaaaatatactgaattcataaatttctggcaagtctaatcaacacagaaaaaagttaaagaaacttggaatgaaaacaattataactagcatgggagcaattaaaaatatgagaatgttatgagcaatactatactagtaaatatgctggaggattttattaaaaatgtggctgaaaagcataaatcttagaagcattctaatgcttaaaccagcaaagcaaattaaaatacagtgaaatattttcactgaaaaggcaccatattcaagatgttctttgaaaattaaagcacacaataacctaaaaacagtggttccccaggcttatagattactatgattgcagaattttataaattattcagtactttttaaatattctataaagaacatagcctactttaataatcatgaagaaagcttattaagaattatttctgcctttaaaagttggaaagcaacatacttaggtgaattaatgatcacaacaattaatgcacccaaagttaaatgctattaggtcaaatatgagatatatgcatgcagatagatatagttaacttttatgaaggcatttatacaaaatgtactgttagcatcaggtgttaaatcaaatataacttggaccaattcataaattcagtctctacatgctcagaaaacaattattttataaagcaatcaattgaatagcagaggtttaagtaagaatttctcaatggcaaaatcagatggatctgacaaagtgtttagcaaaaaacatctttgaagatactttgtttaaaacacaaaacttccattaagtttcaagagagacaagcatttaaggacattcttatcctcttgtctatttgaatcattatttactagaataatcattactaggaaatatgcctgattcattttcttcacatgcttactatatgaggcctgacatatcacagtaattactgtcaagaggattactattaaaagaattattttctctgtaaagtgttttcacttaaaacaaaaagaataaaagtagtcattaggtgcctattatggaatgatctgctctgaaacagcctcacaaactctctcttctactttatgagcttcagatttcactgatcaaatgtcattttttcaaaaagtattttttttaccacttgtgttaaattgtattgttgttcacaattattcactcctccgggaaaattatactttcttgtccagttgactttaggtttggccatgtgacttgtgttttccaatagtatgtgatgcaaaggcacttgtgttcttctatgcataaggcttaagcatcttcacattgttgccgagttcacatcttccctctgccaggatgccttctaatattctgaataaaagccgtcctgtcaacctgaacaccagagggaagacaacatggaaaagtgccatgtttgacctatgattaatgtgtaatattagcaataattaaatgtttattgtcttaaacttctgagatttggggtttgattgttatagtataacctagcttattttcagggattattaccttatataaaacagcagatacgcttcctctaatgtgtttcattttttatagcacttttttttcacttaacatgtatatttatatatttattatctttcttcatccatgggaatctaagctccatattttcatttgtgaatccccagtgtctagttcagttattctagtaattattattcagatggaagttgcaggaagaacatctcaaactaaggtggaaattctcccaaaatgccagagaagagatacaagctgctgaattagatcaacttcaattaatttttttagctggagggaaaagaaatgaatcaaaatgggaacgacagtaaattggaggactagcttactgcacttgtgtagtcttgatccaatcaggacagggaaactataagtaattcgaacagggcaagtttaatatatagaaacattaaatattaaatagggttggagtaatgaagggtaggatagtaagaggaaaactaaataacaaatgtaagaagcagccagaagtacaaaacaataacaaaaagaactagggttgagataggaagatcagaaaagagacttagctcctctctttttccccatccatggctgacatttagaactcattggaggttatggttctgactccctgcctggcagagaagtcactgtggttctgcacctgtggaacttgctgaaaatatgtcctttaacagaaatatgttgactaaatagtgtcttactgtggcattctactacaaaaccatccaagaaggtttgctgggggaattaaatgctggtctctataaactgcaagagcagggtgattaaaaaaaaaaaaaagctacctacattagcatgtcagaacgaggaagcaaaaactctttcctcttccagtgtctgtccagcaccctctatttacacagcttgaagtcatgataacaaaataaaataacttgtagatcttagatttactttaacagatcagacaatgcattatgaagttggagcctaaaagcagtaagttgataactgacataccggacaagagaccttgatgatcattccaaagaagtgaaaagggagtgtaatacttttgatagatgtagagccattaacaaagtagattgacgggatttgataacagattgtgtatgtgattgaagaagaaggagaagtcaagaacccctagattgtactgtggatgattgatgccttggaatgtggaattcagaaagaaagcaatctccttctttgatactacaaaaacaaacaaacaaaaagattcaaagagattttcagggaatgaagttagtgagtaacatttaattcaatacatcaaattaaagatatgcattaaatatctatatggaagtgtcctctgggtaattgaatataaagatctggagttcaggaaagagatctaacctgggatacagatttttaaattttctacaacataattattaaatatttcatatagatgctagcagagaattgctaggtaacataatagaaactggatgatattagcaaaagtgcagtgaaggctgctaaggacaggtaccctagaggacactaatatttaacggtacccttttattcccttggcttctgtcagttaggatgtttaattccatttatactcttagcagggtcagcccttatgtagcacagggagggtttgttcctagttgggacattctatataccatctttttctgatttatagcaaaccataacatgcatgccttatccatatgtagaccatgaattttaaaagcaatttctcatacaatgagtgaatgatgtaagctgtcaggaagcaacatcatctcaataaatcaagagtgacatctgcatggtgattcatagccctgggtagaataaactggctctctaagggtgaagtttcttgggtaaacattcttaaatgagttagtacaccctctggggaagtcagagagctatggttaaaaagtttatgggtaagaagacctacagtctccccttgatagcttgggttctttctatattaccatcactgtagtcacagttgtgttgatatttataaaggaaaaaaatgtaaagaaaacaaaaagaaaggaaaaggaaaaagccaaataaaaaaatcagtataaaaaagattagattttaaaaaatcacaattttcaaagtaaaataaaaaagaaatattaaagcaaataattttatgagtaaacaaataaaaatatataatccaagataaaagttaaagcaatgagatttaaagtaaatattacaataaataagatacatatttaaaatgtaaaaaaatcatcttaatgtcataaggtaaaatataaatatgaacctatcaaattaataaccaaataactacaaaatataaaactgtatgttttttaaagctagtaaaacataaaattaattttttaatgagaatagaaaacattagttgatgaaataaatactaaggacgtagaaggtagtccaaggtgagttaataaagtatctttgaatgggaggttgtctgggtacaactgaagcaatcaaacataagaagggactgggcatgatgctcatgtctgtaatcccagcactttgagaggctgaggttggtggatcacttgaggtcaggttcgagaccagccaacatagtgaaaccttgtctctactaaaaatgcaaaaattagccgggcgtggtggtgtgtgcctgtagttccagctactcaggaggctgaggcatgagaattgcttgaacctgggaggtgtaggttgtagtgagccgagattgtcactgtgctccagccagggcaacagaggaagactccatctaaaaaaatcttaataataaataaaccaaaaacagaagcagggcagggatatgtactcttctgtatatttagtttctaatgtgcagtccaccacattggactaacctaccctaattacactgaagaatggcatctaatctacttttaattctagccttcattttgagtcaggaagacatgaagacccctactcccagtgacctactaatacttaggcattaatgagcccaaggctctcagaaacgtcagcatgctcagaaaatcagagcaatatgagattaactcatgtatcccataagtcattgttttataccgaatacaatcacaaaattatatttggaggaaaaaagaattaaaacttgaatttaaaaatctaaaatcttagcacatagtcttggcatggcttggggtgaaaaattcatatgtgtttattatctatttatctcagaataacttgaagaataatctccctatgaagattatagacacagaagtttaggcaatgacctatgtgtgttatcaacctttggttcatatttctgccattacttaataaatcctaggagcatttgtaatatagaatgaaacaaataattttgtaattacaaagttgcaggtttgaatctcagttctattccttactgattgtgattttttttcatgtctcagatcctcaaacctctaatatgtaaatgataacaggctgcaacttgtagggctattcagaagattaaaaatggatacaaaacatctggcatagtgtatgacagagtggatggtagctctcatttgagttgttatacttgtagctactgagtttgcactgctctaaatcagcattactctttaatcataaactaatttgatcactagtaaggttttgaaaggccacaagtaagccaattaacttcattaattcgtgtcaaaaaatgaacactattactctttctagaaatttcagttactttcccttcaaatcacctgaaagtcattagttaataaaatacatatttgttaattgcagttaaagtaatttccatgctgactaacccattaatccaagtgtctttgacattagtaaattcttattcagtagctagttttgtcagaattaattgattagatgaccattcacataaaaataagggccaggaactgtggcttactgttgtaatctcagcactttgaaagaaagtggaaggtggattgcttgagcccaggagtgaccagcctgggtaacatggcaaaactctgtctctacagaaaatacgaaaaattagttggacacagtagtgcatgtctgtagtcccagacacttaggagggtgaggtgggaggattacctgagccctggagttacaggctgcagtgagccgtgagcacactagcctgagtgaaaaagtgatacctcctctgtctcaaaaaaaaaaaaaaaaaaaaaagaggaaataaagaaagaaaccaaaagaaaaagtaaaagaaagaaaagaaagaaagaaatgaaggggagatggtaactcaaacatgacagtgccagagtacgtgtgaaacttagtcatttatcacaataggatttgcctccaaggtaagaaaagttgttttaagtgttattgatttttacttgaaaaaggtgtcctactgatttttgccatctagacccttaactatggcttttagtaaactattcttgtctatattgacaaccatagaaaactcaggaacagaaatgtgatggtcactggtggagaaaggggaaagtgaggtttcaaaaaatactacctaatagccccctcccctatgcaccatgtttgatattatttcagttctacttacttctgatggggaaatacaaggtttttagtttttttgagtgaagctgtgtggtgagttaaacagaaaaatctatgcaactcaatttgctatttcaaagctcctatgcttgtgggcaaagaattcttggatttctgccaacactgaagttcaaattatttggaggggtaagttgcttgagtttctgtatttcttttaatcaggctttgtttttcacagctgtcattagtcagttctattttattaccttttgggacttggcattcaaacatttggaaatgcatttattcagtcagtataaaaaacaaacaataacaacaaactgctgggattctgaacactgtttatcatctggcattgcacagtcaattttttttttttttgtacttcaatgaactacttctacactgctactcaggtgtaacatccggagacaatgtctttatttccctttctcattttttctttctcttttatactactttctctctcactctgtcctccccttcctttcttcttccttactctctcctttcttttcctttccttcttcccctttgcaggattccttctgtctcttttcatttaaatttgaaagctcaaaaaaatgacttaatttgaaatttcaatatttgtgcaaaagggatttgtcagaaaatagaatttattattttatttgtatcaaattttgagcaaaacaaagtgaaattgcaaagacaattctgtaaatgtgtgaatatatactatatcaatgatttatgattttagtttgtgtagaagcatcataagttagggaccatctgtagttaagaatgctatattgattttttttccagctccatataaaaatttgatttccagacgttgattactgcctgaaagaagaaaaggttaaagagacaaaaaaaaggtgcctattatctggacaagttattaacctaaagaagattaaaaaatcttattattcaaattactacaaatctgtagttatgtgttctaacgaatcccattaaatatatttactatagaaaaaaacaattccggtttctgctttgacattttagttaactgtaaatgccaacattaatataaactaacttttttttggatagaatcagacacattattcaactatcataggtcatctaattagttgtgtcataatatctgaataaggttattacatcatttcatgtatcagtatccctcattttatgcttgatgatcattgaagcaatgtaagttgccttcagtcacgtagagtagaataatcaataatctagccccctccccccaccaccttgttctatctggtccatgttgtactttaactttattaaaattagacaaactgtctttaagaagatgatatttcagttaacactcaagcagcgaagttaacaataggatcagcccacagcataagtagtgtaatcgacataggggatacagtattcagtggaaggccagccccaagtgaggtggaaaacattaatgggtttgaaaagcagtccttttcttctctacaattttcttctgactgattctgggaaaatgctgagacaattgaaacccattatagacacatgattgtgttggaaaagttatacaactttttttcttttttttttgagacggagccttgctctgtcacctcggctggagtgcagtggcgtgatctcggctcactgcaagttccgcttcctgggttcagggcattctcctgcctcagcctccccagcagctgggactacaggtgcccgccaccatgcccagctaatttttttgtatttttagtagagatggggtttcaccgtgttagccaggatgttctcctgacctcgtgatccacccacctcggcctcccaaagtacggggattacaggcgtgagccaccgctcccagccggaaaagttatacaacttttatacaaaatatacaatatttttaaattatacaatttaatgcaatttcgattcttcttgtttggaatcataatgaggagaggatttaagagtgtcaaaaagagtaatgttaaagaaactgatcgttttcctcaggcaaaattggagatgactaattatactgcctaaagttgagactatttttgcttgcatctttatctaaaagaaaactattgaaatagtttcaagaagcacaaaaataacagaaaaataaaccattatatatgtggggttttttaagcctccataatatttcaattcaagaaaataactacattttttaaaggcatattgttcaaaattgtcttcctttttcacttggccaatgaaactggaaaagtagtaatcaaaactgcaattcttaaaacaagcttgatgcaattttgattaaagcacttaaaaaatatgaggcgtgcttcttcatactgtcctctatttttgcagacaatgtcacaaaggtaccattagattcgtagctggttacaaacctctaatttttagctattctacttaagacctgcactctggcaccattaccctaagacttttctatagctctaagatcaccattgtcatttaagcctcataactaagaatgaactttgtttaatcctcaaccatgtaactcctcttctaatgtaatctagtcctccattcagccttaaaatattgttgatgtgtcatactgcattaaaaaaaaattctatgtgtccacaacactctttccttaacatcttctggcatttcatcacttgctcttttgaaaaaaaatgcagaaaaataggatctaagtttgctgagaattattactttattaatcttttttttcacaaaatgtcatctgctctgatgtgagtcacaaaaaaattatttcatgaaaacaagaagaatcataacaaagaattcccttgtttccccacaaatgtttttgccaattagaaacatcaacatagctttgtgctttaagaatacctttgagaaaaagatttcaagtttttttcctgaggtattatgagtttagcacaccgaccaatctttctgacatacttcaaatcagatgtccttaaacagtgaagcagcagtttttccctgaaactgatatttggtaaacatttatcaatctaataagtagtaaacagatcataccataaagatgaaaacatctttattcaaatttacttttatagtactgaagcccaatgctgtcatcagaatcaatagaaacttgtgctgaatgattggttacttagttggaagggattatacaaggtatgtattttacaagcactttgaccatgtgacatgcataaattgctctataccactgctgctgcctatttcttatatgaaactttcatggtacaaaacagatcagggcatttacatatagtctataaaatattcatggaagaaattttgttgcaaaatataaggtaaaatattaagaggaggaggaagtgtgaagactgagaataaaatcaggtagattaactaagaatgaaatcactgtgaagacacagaaaagtcttgcagtaggagaagaggatttggaacatgcttgtcacctagcagacacatgctagattaggcagaattcacacattagccaagtacaaatgcaggctaacatgtaaacgtttcagttttaatttcgagacagtaggacaaatggtcagaaatacagacctagatggaaaatcctgcaaatcactagaattcgtactcctattatctgaacaagcaagcaaatcagactgtgacttaagcaaaggaaagatttcaatgtgtaaatagcatcagtttcataagccattcagtctctgttactattaaacataatggcaaaaaccgcatttacttttgcactgacttaatactactcaaatctttccttgcaatgggaatgaaaccacagaccatatgtaaacaaatgagtatggctatattccaatacaaatgtatttatgaatactaaaatttgaatttttgcatgatccaaaatatgattttcttatgattatatttccaacatttaaaaactgtgtaaaagtctttcttagtttgcaggttggacaaacaatatatgagttgactttgacctgtggattgtagtttagtaacccatagtctaaaatataaaatatgtgtagcaagtgaggctgcttttctgatgctagaaatatgtggaagcaaggttgattgtttgcacatggattttctggtctgaaatttgtttctaagaataaatagcatcagcaacttgctatattctaattcaattcttttgacacaatagcctatggcttaatttagtgacaaataaaagagcttaaattacattgatagattgtgcataatattacttctatatctttgtatcatgatccaagtactattataaagctatcttaattttgttcccaagatggcatattaggggcttttaacatgcctcagccacttggaaatagcaagatagcacataaagatcaactctgtgagctttaattcaagaaggaaatcaggaatctaccagaatcatgatggacaccccagatttcaggaaggaagatgctggcaaacagcccctgtgatggcgtctggcagataaaagttagtgaagtcccagtacatgagagaggaagagagcatccccctgtgattcacctttccacctgggatttgggcaatccacgaggaggaagagctctttgtttctcccaagccctgaaggtaacttgggagagggatggagacattataaggcaaagacactgggaacagctgcagacattttcccagaccgtggaccaagagcagcacaccatttttaatctgtgcacatacactgtcagccattattttgtgtgactcggaagagtggctgcacaggcattttagtttcaagccagagattagagtgcctgctctggagcaggataggggcctccacagccagaactgtggaaggtgcctcagcagtagatggtggaattgtgctctcccgtcacaagcctggagcaggagaagagctgctacagctgcagtttctcctgggtggtggacttgctgccagatccagcttagcgaattagagctagtctgtgtgtgccattgcttggtgctcaaggctgctccccttagactgtgtttaagcagggccctctctgctccacccccagacagaaatccaggcatttggagcacctactcttctggaccagcagcctgagctgcctcaccctttctaacatagatcatggcacagatcttcacacacaggcagaactccaggtatttggagcacttgcttgcccggaccaacaacccgagccacaccacctttcctgtgcagagattgtggtacaggaagacactttctgctctatgcccaggtagatctccaggcattcagaaaacccattcatctggttcaaccacttgagttgccccacccttcctggacccagatcttagtgcaacagggccttctctgctgcatgcctaggaagattctcaggcatttgaagcacttgctcacctggaacagcagaatgaacagccccacctttcctgtgcagagatccaggtgcagggggccctctctgtcataagcccagtcatatctccaggcattcagagcacctgtttgcctcgttcagcagcctgagttgccacccctctcctgtgcagaaatgttggtgcagagggtccctccctgctccatgtccaggcagatctccaagcatttggaggacccattctcctggattagggttttaggctgtcccccatccccatgcagagaattgggtcagggagttttcccaactccatgactaaacacacctctgggcacttagtggccatccactggattattcattggagctggtgctcatgtctgccactgggggacctgtaggcagacctggccagtttggccctgcctatctttgccccagcacctgcttcttgggttgagggacaggggtgggcaagcagggagataagaccactttgcactccacagaatagcccattgcctaggcagcaaagaactgcttacagtaaacaaagatcaagaatatgcccagccatgttggccacagctggctcttacctataagtttcatctactggtttgtaggttgaactacactgcctaacacaaaatttggtatcagatgtgcataaggacatggaatcaaagccagaaagccctgcccagcattatctagggtgacaacccctaaggaggggagagggcaagggaaagggaaagaaaaaagaaaatcaataaaattattggggaaaaaagaaaaagaaaaaaaaacacctgaaagaaaataaatacaaaaattagaagttctagtgtttccaaatgagaatgaaccaacacaagaattgtcatcattaaaaaactgagtgtagtgacatcaccaaaggatggccctagctctccagtaatggtccataaccaaaatggaaaatcagaaatgaaagatgaaaaattcaacaaatggatttcaaggaagctcaatgaattccaactcaagtttgaaaatcaacacaaagaaagttttaaaacaatccaggaaatgaaggaagagatacacatcctaagaagaaatcaatcagaacttctggaatttaaaacaaacaaacaaacaaataaacaaaaaaactcatttaagtaatttcaaaataaaattgaaagttttatcagtagactaaaccaagcaaaagaaagaatttcagagcttgaggacctgtgtctcaaactagtcagacaaaaataaagaaaaaaagaattaaaaaaaatgaacaaatctttgagaaatatgggattatatacaccaccaatcctataagttgttcgcattcatgagagagaacctagaaaaactacttgagggaaaaattcaagaaaatttctctaatcttgctagagacttaagtatccaaataaaagaaatcctgagaacacctgaaagatactataaaaaatgagcatcaccaaggcatatggtcaccagactgtccaaggccaatgctaaagaaaaaatcttaacccttttcccatttttccagagtgctccccagtggcacttgcagctgcagcatttgcccctagataactttgcaacaaaatatctcgcttttatgattattttcgcatcactctatcaacgaatgaaacaaaagacttcattctatttataccattctatttttttgtcaacttcagaaacaaaagacttcattctatttataccattctattttcttgtagtggtatttccatttacaaaatatagtcattctcaattgctgaaaatgtcaaatgctagaaaatgtagcattgctacgcatgatgttaacatcgttcttgaatggtttttggacaaagatttatttaatgagttttctgaaataggcgattctgatgattcagacaattctcatgttagttatgtttagaaataactccaagaacagtttttatactctattttcacatttaaaatcagtcagatttgctttagcctcagagtctgtttatataaaattaaatgagtgctggcagcgagctgcacttttttttctaaatgggaaaagggttaaaggcagctagagaaaaaggtcaagtcacatacaaagggaaccccatgaagtttataatgaatttctcagcagaaatcttacatgccaggagagagtgggggcctattttcagcattcttaatgaaaggatacttcaaccaatgatttcaagataacacagagaagaaaagtgaggcccaattatctgttgcctataagaaacacatttgatctataaagatacccatagactgaaaacaatgggatgaaaaaaggtagtctatactaagggagaccaaaaagagcaggagtagctatatttatatcagacaaaacacctttcatgacaaaaactgtaagaagagagaaaggaggtcattataaaattattaagtggagaactcagcgagaggatgtgacaattgtaaatgtatatgcactcaaaaatggagcaccaagatatatgaaagaaatattattggagataaagagctaaatctcaatacaataaaagcaggagactttaacatcccactttcagtattggacagatgatgtaggcagaaaatcaaccaaaaaatggaaattaacttgtataaaaaataataaatattttgagaacatttcatccaatggctgcagaatacacatttttctagtgagcacatgggtcattttccagaatagatcatatgttaggtggtaaaagaagtgttaaaacattcagaaccttgaaataatatcaagaaacttctctgaccacaatggaacaaaactagaaattaaaatcacaaggaattttgaaaactatacaagtatatggaaattaaactagatgctcttgaatgaccagtgggacaatgaaggaattaggaagaaaattgagaacattttgaaacaaatgataatggaaacacacataccaaaatcaataggatacagagaaagcagtattaacagggaaatttagggctatacgtgtctgcaacaaaaaagaaggaaaaacttctaataaaaaccctaacaatgcatcatcctaaagaataagaaaatcaaacccaaaattagtagaataaaagaattaattgaagatcagagcacaaataaatgaaattgaagtgaagaaaacaatgcaaaacaccaacaaaatgaaatgagtttttttgaaaagataaacgaaattgacaaacctttacccattcaaagaaaaaacaagaggatccaaataaacaaaatcagagatgaaaaaggagacaatacatctgatactacagaaattcaaaggaccattagtggatactatgagcgactatataccaataaattaaaaccaaatactgcttgttctcatgtataagtgtaaactaaacattgggtactcgaggacataaaaatggcaacaatagaaactagaaagtaatagggaggttggcaggcagggaaaatgttgaaaagctgttaaatactatgcttactacctgggtaatggagtcatttttaccgcagacttcagcatcatgcaatgtacccggtaacaaacctatatatgtaccctctgaatctaaaagttgaaaaaaatatattatttagatttaaaaagaaagaaaaataaagcaatcttaggttcttgggggatatattaaaataattagcttttcttatctaaaagacacatagatgtaatatatatctaaatatagcaacatgtctaatttatctcataatagttccttgaatttcaggattcagtgccaaagtgataactatgatatctaattttaaaaattacgttcacattttcaaggtactattgacagggcttacgggaaccgttctatagaaaaacgctgtctggagacaaatcagagttttgctatttattactgtataattttgggcaagttacctaaaccctcagtttattcatctttaaaatggagatattccatagggtaactttgagttaagctatgtaaattaaatacttagaatatatactaacacaaagtaagccttttagagttgttttgtttatcattgtgagaaagcacccgtatcatatatcattccctcattctcacaactccctgagtaagcataacacacatgcgcaagcgcacacacacacatgcacacacacatacaaccacacacacaaccacataattaaagatataagaagaaaatacatagtaatatgcattttaatatatgcataacataataatattttattatgataataactaatcgcgtaattttgctactcatgttaggtgattaatataaacttgctttagataaactttaacacatcttgatcaactttcaatatattcaatatgttcaataacttatttcctagttataatcctcatttcaaacataaaatacatcttatttcaaaatacacaagtacaacaagaggcaaagttatgtcttacactaaatagatacttaaatgactgtttgacgtatatggatctgagaaaaaaaaacattatcaattagctacctttaattatatgaacattttttatgaagggaataaaataatggtattcaattgaaaggttactcttcatcttatttaaatcactctgtacctctaattgaacattataaatgataaatgatggcattgcactaaagtgtaatatattctatctccttgcctttattacatttaaagaataaattataaaataaacgtttacaagtttagcatcataaaaaacccaaattttgagacaattaaacaaccacaaaaccaaaactacagtcaaatatccagagagattatgtataaaatgctaaatatacaaatacaaaaattgatgagctattaactttttaatttttcacttacagatcaaaatatgtactttttcaatgatctagattatattttctaatattatcaaattacacatggcttatgattttcaaaactttttataacattttttcttccagaaattcttgggtaaagataaaatacatttcaaatttttactatgcattttcttcctatttacatgtgcaccataagatagtttttcagtaaatcaatacagactttttcagggatcatatcacgcctgtaatcccagcactttgtgagggcgagatgggagaatcaccagaggtcgagagttcgagacctgcctggccagtatggtgaaaccccgtctttactaaaaatacaagaaactatccaagtatggtgtcaggcacgtgtaatcccagccacttgggaggctgaggcaggagaaactcttgaacctgggaggcggagttgcagtgagccgagatcatgccattgcactctagcctgggcaacaagagctcaactctgtctcaaaaaaataaaaataataataattttaaagctaaatataattctggtctaatcatccaatgcaagtagtacacacatgtttattttatagattgtaataacaagtaattaagactagtaaatagtaaccacttttatttgaacataaaatatacactgaatattactgaatctcttgtttatttaattcgtatcagttgaagtatttactctgcatatgatttggtccaggctctttgcattctttttaggacagggatatatataaatattttccccaaacacaattaacctcattttaccttcattataacatatacttcattcgtttttttgtccttaagtgagaaaacttacaacactcagaaaaattatatcatgtcttcaagattgtgctgcaaatacatgtcatcgtcaaaatttgaatgcaggttttaatgctagcctagttctcttcctagtacccaagagatgacccccagtaaaagggaatgcacttactgattgttccaaaagtggaaactgatttttggtcccatggaaacatttattttaatcatatgttgatagaaatcttctagaagactactctctcttcgtaaaaagaggccactacagggaattgactcttatcgtgatgactcccagccttcatcatgaacatccattttcacatcctgtggtgatgcagtgcctgtcaagctgtcagctgtcatgtctgtgatcatcccgtttgcctctaacagcctctgctctgattcctctcaatcatttagggtcagggaaccagatgaccaaggcttttaaagattgtatgtaaagattgtctgttttttcaactgtaaaatgaggttgctataccagaccagtggttctcaactctggctgcatatttgaagcactgtgctcacacaccattctaggatacaattggtctgaaatggggctttgccactgatctttttttaaatgatcctgaagtgttttgctttttatttccattgatacaaaatagatgtacatatgttggggatgcatgtaatatttttatacattcatataatatgtcataatgagatgaggataatggagatatccatcaccttaaatatttgtcttttgttcatactgggaaaatttgaattatttgcatctagctaatgtgaaatacacaatagactattttaaaatatagtcaccctaaccagtctatcaaattaggtcttagttctatctaactttatttttctactcattaatcacaaagataaaaaagcaaaaaaaaaaaacattcatttcaatgaagtttataaataaatacgaaaaaattaaccactgaacagacagttgtaacccatatgatagagacatatgtaaattcattgttatagcagcacagataggggcaaccaaaccaacctgtgggagaaggtgatatgatttctagaggaagtgaggattgagttttgtcctgaaaactcctctaggtgaaagaggaaagaataccaatcaggagaaaatatatgcaaagttaaaaagatgtaacaatgtaggatatttagggaaatttcaagtacgcagttcaatatgagtgccctgtagagaacatggtggaaagcatggaaagcttaattttaaataattagctttgagcgaattcacagggggaaaccttctttatttcctgccaaggattttacattttttctctaaaggcaataggtaggaattaaataatctgaattagcaaaacaaaaacatacacataatctacattccacactcaggatagaaacattagaacataattgtcctttagcaatacatatacttgtggattttaaggaaatactgatgctatatcttgtttggagatgaacagtcagtttagaagtcactgcaataattaagagtaattagtaattggctatctttttaggtaacctgtgtagatgagtttgtcattcacaaactctaatgccaggagttaggaggattaaaaaagtaactttcattttgacttgtcagtgctatggtacccaggagacagttaattgaacattctccatatctacataagaaagatctgagccagaagagaacaaggcagagcatataagtatggtgaaataagtttataagatatttaaaactatgattcataaaatgatgatagaaattgagattcaagaacagaactctcagaaacataaatatttaaaaggtagatggaaaaacagccatcagtcttttaaatatttctagacatcctcctattgaaggacctgtgtagtcaggagtgtccagtgttgtagaactgtgaaaggactgttcacatttaagtggcggaggttagaagccagattgcagagtgttgagatgtgaggaggtatttttcttctttagaaaaaaaaatccctacatgcacctagttgcaacttttttaaccaatacttaattacctaatttattatttgagaaaccacgtgggaaatcataaaggccttcctgaattaagtaaaatgttaccttatttcatattaattaaccccatccctcttcagttacagaaatttcaaccatatttgatgttctttcaccaatctcttgatggctattagactgcaaattcccaaattaggagttagtactaacttcatctttcactttggtaacatttcaaccaatggctatagagctatgtacacaatggctactcaaaaatgtgcttgctagatttactcttctgcttagttaagcaatcagggaatgaggttacatcttcttaatttcatgccattcagaatcatcattttaaacatcattgataatgtaagcatttggaaacagaaacttttaaaacattaatatttttctttacagagaatttactgaggaatgttgaaagttaatacagatctcagtattcaaagggaatagaaaaataaatattctttaattaattattcttaaataatcaatcttctataaatataccatggtaaaacgagttaatgggtttcacataaaatccatttgagactaaatagctgagggaaatgttggtcaaatgtaaaaatatgaaataggatggtgcaatacaaatgcagttattaatttagccatgttaattttcaattaacctttcttcatacttcagaaagcaaacgactaaaactgttaaacgaaagactattggtcttctttttcctaacctctaaagatagacattctctagtgttcagctcttggatctttttcttctacctttacactcgcttcctagaaaataacatccagtcccatggcttaaacaccaaatgtatgctgatgagtctcaaatttatatttccagttctgaacgcaccctgatttccagatttgctgatacaaccaccaacttcatttctctatttggatatctctgatgagaatctcaaatatccagagctgaaaccctaattttcacccctcaccaaagtggggagcaaagcaaaacaataaacaagctgttcctccatttagtttagccgtttcagtcaatggcgccaccatcctacatgagcctaagacttatcctttattcctcaacttaccttattccacccctacatgtgatggctcagtaggccttttgatttgtcatttctaccttcatcgcctattttggttgcactattcataacctacctactgtaagaacttccaaaccactctgtttcctcttttttttttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccacacaacagtccccagagtatgatgttccccttcctgtgtccatgtgttctcattgttcaattcccacctatgagtgagaatatgtggtgtttggttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggatatttgggttggttccaagtctttgctattgttaatagtgctgcagtaaacatacgtgtgcatgtgtctttatagcagcatgatttatagtcctttgggtatatacccagtaatgggatggctgggtcaaatggtatttctagctctagatccctgaggaatcgccacactgacttccacaatggttgaactagtttacagtcccaccaacagtgtaaaagtgttcctatgtctccacatcctctccagtacctgttgtttcctgactttttaatgatcgccattctaactggtgtgagatggtatctcattgtggttttgatttgcatttttctgatagccagtgatggtgagcattttttcatgtgttttttggctgcataaatgtcttcttttgagaagtgtctgttcatatccttcacccactttttgatgggtttgtttttttcttgtaaatttgtttgagttcattgtagattcttttcttaacacactaaccatcaagatcttctttaagatacagaccagatcatagatcatgtcttcttgttcaaaatcctatagtggttttctgtcacacttagcatcaaaggcaaactcttaaccatgagctacagtgtactattttgtggccttttcatggttcttgaaatatgacaagattgttctttctttagggactgcaatagtttgaatgtgcaccccaaaatttatatgttaaaatcctgtcccccaagatgataatattaggaggtggggccatttggaggtgattaagtcatgagcagagccttcaggaatgtgattagtgtccttataaaagagatctcagagagctatctagctccttctaccatgtgaggacacagcaaaaagctacttttctgttatataaaccaagaagtggaacctctaaagatgtcaaattagctgtagtcttcatcttgatcttctcagcctccacaactgtaaggaatacatttctgctgtttataagctaccagtttagagtattttgttatcgtagccagaaaggtccaagactagtttggatctgccatataaagagaagtcagtacctattctctaggatggtctttggcaattaatgtttccttgccttagagtatcctcacctcattcacggccttgataaaatgtcactgatcacacaggtcttccctcttgctacctctttctatccccttttctggttgtgtaatttccttgtgtatgtttattttgcctcctaaaacatagtctccaataaacagagaatttggccaaatccccactatgttaaagattatttgacacacagtagatgatctattcatattatgagatgaatgaacccataattttaaatgcatgcagacacattgtatttgaagattgctaatatacttttagtaacatctaggtggttgaattatagtatgtaaactaactgaaaattttacaatttattttattttacattcacaggttatctcataagattatcataatctaggcagatttatatatcctcactttacaaatgaggagaatggggctaagagagagaaaaaaatgacttttcccaggtcccacatgtattgaattgttagagtctgggggaatcccagatctgatggacttcttcctacagagctaagcttcaggactaatgtgcagttgtttcgtttaatgtagtctaaaagatacatagagcataaattctggccatagggttgcatagtttcacagacacgactgcatttttaaaaagtaaattcttcaaataaattatcttctaagtaaacaaaggcttagacataaaatagcaattaacctatctaatttttccgatgtggaagaaattgcattccttgttacagtgctccgaaggtaaatccataaccatgcacttgagccagaataagattgatattactgaatgtgataggaaaatcattatatataatttataaatttaggcttctatattatgtttcttctcatttcttctttctatagttgtgaatttagagctgtttgaatccaataatcaggaacaaacaaaaagaaaacaatcttatttattataaatttgcaagcatttttttctggtatgtgatacatcatgctcatgggactattgtgcattctgtttccaagatgatggtaatttatttcaaaacctccttagcatacttacttaaataaaaattatgagaaaggatctattactcgtggaaaataaaatatatattacttagtaatttctgtgatatatgtgattctctctatgtatggatgctatatttattatccatgtaatcctctagcatcatatatttaagaatttagatttcattgtgaattcaatagaaatagcctctgaagtaaccatgttaggactaactaatttgctgatgaggtgatttttaaaaatacacaccatatataataaattataaaactttatttaaaggaggctggtctcttatgacaattactttataggctataacatttgcaaccatggtggactatgagattttccctcttcatagtatatttgtattgaaagcttacctacattgttccttcacaattcaattaatcagattttcttttaattataaatgatggttaaagataatgccaataaatttcatccacccactcactcacttattcatcaagcagttttatagttattgagtactatgctagttgcttagagcaaaaagaaaaaaaaagaataggaaattttcaatcttctaaagaaatctatatcctaatgatacaagcaaagaaattagcaattatcatgtagttttctatacacctaacagctactggtattggagttatattacagtttgtttttattataatttttattataaattaatacattgcagttctgatatacatagaaaattttcacaaggttaacataagctcaaacatgaaatatctattccccattagattggaagtaaaagctaatttctgagctttcagagagatttctagaacctggaaagtagaaatttactgaacaaaaatgacttgaaacccaggcagctttctctgccaacactggtattccaattcaccttctcttagtgcacaattaacctatagagacaatatagctttgaaagacagcatgcacaaaatggccattagagcaccccaaagtaatctccagtggattgtgaacagatttttgcatcttaatttaaatctgaatgcaggtgcatggttgtgtgaaacagaatgaaaaatcttgatagtttcatatatagttctaacaattctgaaacaaccattatgagcaagttttgtaggcatgtttacttattaattttacattttaatagcagtaaaaccaggcagtagataggagttaatatttattaaatagtataaaatttaattttattagatgcaatattttattgaatcttaacaaaattcttggttgaggttcagagtgaagaggtaacatgtttaagaaataagctaagcagtttactaattacacaataattccaatgaaaggcatgtttcttactcttcttaataaaccatatgtagtttttatcttctctgaaccatttaataagatctatatttaaatgtagtcttgatcctttgcattggtaggtggtattatttggctatagctatgcatatcataattaaacactggtaatttaagctcctttaattttcatcaactaccatgacaactaaatgtggaagcccaaactagggaaaaaaagtttcttgtcacattataacctgcaatactatgcatttatttcattaagaaatttctgagcttgctattaaatgaactagtacaaaatgcacttgcagacaccacagagaataaatgattccacagcccatggccttcaaggacaaatatttagtaaatatattttataacaaagtaacctccagttaaaaactttgatttggattcactcttctctctaactacaattttaggagatataaagaatgatgtgcttgtctgaacaacactatcaccatctcctgtatttaaaacattgtttttatctatttccctttattatgtaggtatgtcaacttagactgctccagttttcttctgaaactttataaagtgacagatatttcactggattgaaataacaatatgaagttcaataaactaggatcctgagcaggatgtctttggatttgaagcctgactctggcactgctagctttgtgacttaggagaaacatatgatatccctgtgcctcagtttctctatgaaattgacataaaatacctcatagggtggggttaaaagtattaaatgactaaaaatatgaagaaacggaactctatttggcacaaaagaaagattcaataaaaggaaatttatttaactatctatcatctatctatctacctacctatctataatctatctttttatctatcatctatttacttttgttttttaaatcataaaacagattccaagaaataagtcaaaacttctgaactttacatagttaatgagcatcctcatgtcttcatctctgggtttgcttagtttaaattttattgtctatcctttcaactacttcttcccatcttacctaaaatattgccctgccatttgacaaatacttgttcaatccaaactaaattatgtttggatatgaatgaggctggaaaaaaactcactactatgaaaaaaaaaccaaaaaaatcctcaccatgactcaccactatgctaatttgtcttatgttaaaaacagacatagagtgaacccacagccctgacaaaatcttcctatatttctttagttaactcactctcccaatcccttgagaatttctccccacgtttttttctcctaaagcttaaaatcattttccttttcttctcatgataaacgtttgtgtcctcaacagatcacaagaactcagcaccagtaacctctgcatctgcactcatatgctgccttccttcttgttgcagctgatgagctgtctgctgtcttatctaatttcaacatgctcttgtgccctgtattggatatcctctccctagttgtgaatgacctcatgcaacgattcccctttctttctcatatcatctgctttttcctttgagtggaattatttttaaacaatttcctaatttctttctatctacacccaattattcattacccttttcaggaaattactcaaaaatgttgtctgggccaggctgggtggctcacgcctgtaaccccagcactttgggaggccgaggcgggcagatcacttgaggtcatgcattacctccccttgctcctcaccccttaacaggccctgatgtgtgatgttcccctccctgtgtccatgtgttctcattgttcaaccccacttatgagtgaaaacatgtggtgtttggttttctgttcctgtgttaatttgctgagaatgatggtttccagcttcatccatgtccctgcaaaagacataaactcattaatttttatggcagcatagtattccatggtatatatgtgccacattttctttatccagtctatcattgatgggcatttgggttggtttcaagtctttgctcaggtaaatagtgctggaataaacatatgtgtgtatgtgtctttataacagaatgatttataatcccttgggtatatacccagtaatgggattggtatgtcaaatggtatttctggttgtagatccttgaggaattgccacactgtcttccacaatggttgaactaatttacacttccaccaacagtgtaaaagcattcatatttctccacatcctctccaggatctgttgtttcctgactttttaatgatcgccattctaactggcatgagatggtatctcattgtggttctgattttcatttctctaatgaccgatgatgatgagctttttttttttcatatgtttgttggccacataaatggcttcttttgagaagtgtctgttcatatcattcaccaactttttgatgggttttttgtttttttctggtgaatttgtttaagttccttttagattctggatatgagctctttgtcagatggatagattgcaaaaattttctcctattctgtatgttgcctgttcaccctgaggatagtatattttgctgtgcagaagctttttagtttaataagatcccatttgtcaatttcggcttttgttgcaattgcttttggtgttttagtcctgaagtctttgcacatatctatgtcctgaatggtattgcctaggttttcttctgtggtttttatggtcctagatcttatgcttaagtctttaatccatcttgagttaatttttacatgaggtgtaaagaaggggtccaggttcagatttctgcatatggctagccagttttcccaacaccatttattaaatagggaatcctttccccatttcttgtttttatcaggtttgtcaaagttcagatggttgtagaggtgtgatgttatttctgaggcctccgttctgttccattggtctatatatctgttttggtaccagtgccatgctattttggtaactgtagccttgtagtatagtttgaagtcagacagtgcctccaaatttgttctttttgcttaggattgccttggctacacaggctcttttttggttccatatgaaatttaaggtagttgtttctaattctgtgaagaaagtcaatggtagcttgatggggataacattgaatctataaatgactttgggcagcatggccattttcacaatattgattctttctctccatgagcatgaaaggtttttccatttgtttgtgccctctcttatttctttgagcagtggtttgtagttctccttgaaaaggttcttcacaccgcttgtaagttgtattcttaggtattttattctctttgtagcaattgtgaatgggagttcactcattatttggctctctgtttttctattattggtgtataggaatgcttgtgattttttttttttttttggagacagagtcttgctctgttgcccaggctggagcgcagtggcacactctcagctcactgcaagctctgcctcccaggttcacgccattctcctgcctcagcctcctgagtatctgggactacaggcacctgccaccatgcctggctaattttattttaattttttttttttgtatttttagtagagaacatgtttcaccgtgttagtcaggatggtctcgatctcctgacctcatgatctgcccgtctcagcctcccaaagtgctgggattacaggggtgagccactgcacccggctgaatgcttgtgatttttgcacattgattttgtattctgagactttgctgaagttgcttatcagcttaaggagtttgggggctgagacaatggggttttctgcaaacagagacagtttaacttcctctcttcctatttgaatatcctttatttctttctcttgcctgattgcctgggaagaacttccaatactatgttgaataggagtaaggaagagggcatccttatcttgtgccagttttcaaagtgactccttccagtttttgcccattcactatgatatttgctctgggtttgtcataaatagctcttattgttttgagatgtgctccatcaatacctagtttttgagtgtttttagcatgaagtgttgttgaattttatcaaaggccttttctgcatctattgagataatcatgtgttttttgtcattggttctgtgtccgtgatggactatgtttattgattttcatatgttgaaccagccttgcatcccagggatgaagtcaacttgatcatggtggataagctttgtgatgtgctgctggattcagtttgccaatattttattgagaattttcacattgatcttcatcggagatactggcctgaatttttctctttttgttatgtctctgccaggttttggcatcatgatgatactgtcctcatacaatgtgttagggaggagtccctctttttctgttgttgagaatattttcagaaggatggtaccagctcctctttgtacctctggtagaatttggctgtgaatccgtctggtcctgggctttttgttgttgttgttgttggtaggctattaattactgcctcagtgtcagaacttgttattgccctattcagggatttgacttcttcctggtttagtctttggatgatgcatgtgtccaggaatttatccatttcttctagattttatagtttatttgtgtagaggtgtttacagtattctttgatggtcttttgtatttctgtgggatcagtgttgatatcccctttttcattttttattttctattcttctttcttttcttctttatttgtctggctagtggtccacctactttgttagtcttttcaaaaaaccagctcctggattcattgattttttgaagggtttttcgtgtctctatctccttcagttctgctgtgatcttcgttatttcttgtcttctgctagcttttgaatttctttgctcttgcttctctagttcttttaagtgtgatgttagggtgtcaattttagatctttcccactttctcatgtgggcagttagtgctatcaatttccctcttaacactgctttagctgtttcccagaaattctggtatgttgtgtctttgttctcattggtttcaaacaacttatttatttctgactttattttgttatttacgcagtagtcattcaggagcaggttgttcagtttccatgtagttgtgcagttttaagtgagtttcttaatactgagttctcatttgattgcactgtggtctgagagactgttatgatttctgttcttttgcatttgttgagaagtgttttacttcgaattatgtggtcaattttagaatgggtgtgatgtggtgcggagaagaatgtatattccgttgatttggggtggagtgttctgtagatttctattaggtctgtttggtccagtgctgagttcaaatcctgaagatccttgttaattttctgtattgttgatctgtctaatattgacactgggatgttaaagtctcccactattattgtgtgggagtttacgtctgtttgcaggtctctaagaacttggtttatgaatctgggtgctcctgtactgggtgcatatttatttaggatagttagttcttctttttgcattgatccctttaccactatgtaatgctcttgtcttttttgatctttgttggttgaaagtccattttatcagagactaggaatgcaacccctgcttttttttttttttttttttttttgctttccatttgcttggtaaatattcctccatccctttatcttgagcttatgtgtgtctttgcacatgaaatgggtctcctgaatacagcacaccgatgggtcttgtctctttatccaatttgccagtctgtgtcttttaattggggcatttagctcatttacatttaaggtcaatattgttatgggttaatttgatcctgtcattatgatgccagctggtgattttgcacattagttgatgtagcttcttcatagtgttgatggtctttacaatttggtacatttttgcagtggctggtaccagtttttcctttccatatttagggtttctttcaggagatcctgtaagctaggcctggtggcaacaaaatccctcagcagttgcttgtctgtgaagattttatttctcctttgtgtttgaagctgagtttggctggatatgaaattctgggttgaaaattcttttcttcaagaatgttgtattttggcccccactctcttctagcttgcagggtttctacagagagatctgctgttattctaatgggctcccctttatgggtaacctgacctttctctctggttgcccttaacattttttccttcagttcaaccttagtgaatctgacaattatgtgtctgggggttattcttctcaaggagtatcttagcggtgctctctatatttcctgaatttgaatgttggcctgccttgctaggttggggaagttctcctggataatatcctgaagtgtgtttgccaacttggttccattctccttgtcactttcaggtacaccaatcaaacataggtttggtcttttcacatagttccatactttttggaggctttggtcattctttttcatttctctctaatcttgtcttcacaccttattttgttaagttgatcttcaatctctgatatcctttatttcacttgatcgattcatctgttgatacctgtgtatacttcacgaagttctcatgctgtgtttctcagctccgtcaagtcatttatattcttctgtaaactggttattctagttagcagttcctgtaaccttttgtcaaggttcttagcttccttgccctgggttagaacacgctcctttagcttggaggattttgttattacccaccttctgaagactactctgtcaatttatcaaattcattctccatccagtttttttccctggctggcgaagagttgtgattctttggagaaggggcattcttgttttttcctcatctatgtttatttatctacctttgatatttgaggatggtgatctttggatggggtttttgcatgggcgtcctttttgttgatgttgatattattgctttctgtttgttagttttccttctaacagtcaggcttctcttgtgcaggtctgttggagtttgctggacatccattgcagaccctttttgcctgggtatcaccagcaggggctgcagaacagcaaagatcgctgccttcttcttcctctgaaagctttgtcccagaggggcacccgccagatgccagccagagctctcctgtaggaggtgtctgtcgaccctggctgggatgtgtctcccagtcaggaggcacaggggtcagggacccacttgagcaggcagtctgtcccatagcagagctcaaccactgtgctgggagatccacttctctcttcagagctggcaggcaggaatgtttaagtctgctgaagcttagcccacaacaacccctctccccaggtgctctgtcccagggggatgggagttttatctacaagcccctgattgaggctgctgcctttctttcagagatgccatgcccagagaagaggactctagagaggcagtctggctacagcagctttgcctcactgtggtaggttccacccaattcgaacttcccagtggctttgtttacactattaggggaaaaccgcctactgaagcctcagtaatggctgatgcccctccccctaccaagcaccagagtcccaggtcgacttcagactgctgtgctggcagcgggaatttcaagccagtagatcttagcttgcttggttcaatggaagtgggatccactaagcaagaccacttggctccctggcttcagtcctctctccagggcagtgaatgattctgtctcactggcaatccaggcaccactggggtacgaaaaagactcctgcagctagctggatgtctgaccaaacagccgccagttttgtgcttgaaacccagggccctggtggtgtaggcacccgagagaatctcctggtctgctggtggcgaaaaccatgggaaaagcatagtgtctgggccagatagcaacgtccttcaaggcacagtccctcaagggttcccttggctaggggagggagttccctgaccccttgcacttcctgagtgaggcgacatcccaccctgcttctgcttgccctctgtgggctgcagaagtcccagtgagatgagccgggtaccttagttggaaatgcagaaatcacccgccttctgctttggtctcactaggaactgcagaccggagctgttcctatttggccatcttgccctggaaagaccaatctcaacttttaatgttgatgttctcaggactcaatattttcatcactttccttttctagctttaatggtccgtcatcttatgtagtgcaatagctttatattacagtttagactaatgactctgaaattcatatttttaacctgtttgcataagttttagacttgtatatttctgtccacattatatctcaaatttgatattctttaccataaaccttgatctcatcaacttctgcacctgctctttgtttactatttttactggaataaatggcacgatagtttactcagttattcaacacctaaacttttgaggcttccttgatatttctcctatgatctgtctatattcaatccatctttaagtcttactacttccgtttactggcaataaaggactagtatgttttggaacaattatcttgagaacaactagaatatttgataaaataatgtatgtttaaagcatagtggagccagcagtgagaatttgcagagtcaagattcagtataagagagaaaccaaaagcaatactcccaagagaaataatctcagagtataaaagttcttttccctttgagctgtggattccaaaagcaccaggtgatattttgagatgtatgaacagagcttgagcaatgtcactaagctgaagacacaaaaattgttgacgagatagagagaagaaaaagacaacctggtaaatatcttaagctttgagttggaatccaaagggctataccctacaaatgtgagcgaaatggaatagccagttcacactgagactgaagaccagttaccaaccagctcaattctaaattgaattaagatagacattctatatactagccatcaccagatgcaaaataaatcatctattaggaaatataatattatacagatttttcaattatttccacttttcacatatttatatctggcattcagtattatatataagacatacaacgtatccaaacacacacccacataaaaatatatacaatataaacatatttataggaaatctaaatgatagaaatatatttataggaaatctagataatagagtgattatatatattttaaaatatctgcattaaagtatttacaagacaaaatgaaatttcaattgatagttctacttctgagtatatacagataattatgtgacaattaagaactgataaatataattactttaattaagatattggtgaattggttgaatatcatattagtcacagttgaagaggaaattgttacactaaaagatgagtcagatcaaaagatttcaacaaaagcatgaagagaaattttttaaaaaatggaaatgcagaaaagattattaaaggtatgtgatcatggtaacaagctgaaacatatttgcaagtgcagtttcaagaaaagaggaaagagagaatgggacataagcaatacttaaagacagactatttgaaaatctttaaatgtgaaaaatacattaagcctatgatgcaaacagtgtaattacaaaaaatatcacagtacgtacatagtataattacatgttatcacatgtatacacacatagaattatattgaaattatcaaaaccaccaactacttagaaagaaatgtaatacaaaatgtgtaaggtgtctactcaaaaaacaatcattattgataaatttaacacataaataaatggaaaatgtaaactcaaagactcaattttgtaaagagtttatttctctccaatttgtttaaaattcaacacaatgctaataaaacccaagctcaatttgatgggaaatttaatacttatggagatgaaaatagtcacagaggtatatgaccatcctgaagaagaacaaaatgagattaccattctacataccaagatttactattaagccacaataataaggagaataatagtggtgtaaggatttttaaaagtagaatagagtatacagaatcagatccacctatacagtcttggtttatgaaaaggtagccctacttgaccctgagaagaggatagtctttttgatgaagagtgctggattggttgtctacctgagacgagtgtaccacacaaattgtttgttacggaatgtgcttgggatcatgtatggcatggaagaatatcaagcagaggggaatatgaagttgtgattcaggcccaacaaccgttttgaatgatcccatggaccttctgtaactagagtggcctgacggagtggtccttcactgggctaaggtagccaaacctctatactactgattggatcgccattagatatgagccacccttggaagagagagataatttagggtgagttgacactcttcagctgagttaatatctgaagggattgatagctgaaggccatattcagatagcaccctcagcaggtgcagcagtttctgaaggcagacctggaaggtgcgttagagtatctacttcactccattttattctaaaaatatgatttattattatgtcatgtatacactgattaattcattcattgaccagtaacttgataacggcaaggaattcttctcttggttattttttctctaataatatattttacaaaaactagtgttccacaaatatttttaaacaaatgagggtggaaaattggaggccaaactatgaagtgtattgtaattattgataaaaatgtgtcagtatctagttaattctgatatttttgatatcagtcttatctaaatttaatattcagctctgataagtattagctaattagctttgggctcctaagttattcttttttggtgcaaatacttcatttggtatatgatagagaataaacaagttattcttgaaaaacaattagatgacagttgtaatttttagaagcaaagaaaatgtaacaattaagattaaagaaatataattagttttattttactgtcattctctagctagtcacatttaactaaaaattctaagtaatggagagaaattttcaatttggattatttcaataataaaatatttttatttatgtctcattaggagatataattgtatgcctcatgtctagcatacaatgcctagaagtcttcttcattctgttttgaaaactcatcagttagtttttcttttgccaacaaatactgttgtctaaatgtctgagagctttcgccaataatgacattcattacccgtcagcttcttttataaaacttgaactttaaaaatacatgttttattactattataaatccaaagcaaaataaggaggaatacacttttaacatgtagcttctaaattattctgccacatgtactgtttaggaatgaattatgataaatttccaaatacattatcatgaccaaaactctaactgatgtgtctttccagctctttcttagtgaatcttaactcaaatatttcagatcttcttttctctgccctagttaccacctctacatcaattaccctttgtaagctagtcgtttttcttcttctattgtactttctgtaaatggcttttttatatgtccaaaataaattctaaacatgacaaaatgtgaaaggctatcattaaatctgtttcccttaaaataactttttaaattaagttttaattttacaataattttgtgattattatgtctatcttgacattagagaaccagagctgcaaaaatatttagaatgagctattagagtacaggaattgaattttcttgtaacaattgcagaattagtacattactagtatttatataatttgatgtattttttccttgattgatgtaattcaaatgagatatatctttcagaattatttgaaaataataaaaatatgtcatgtcagggtcactttagaagtgaccgcaatcttctcattacagtaggatttgaattatcaaggttatttatacatcagaaagaaattgttgtatataagcagaataatgaaactagactcctgtctttcaccatgtacaaaaatcaaatagaaatggattaaagattaaagactgaaatctaagacctcagactttgaaactacaacgagaaaacctctgggcagctctctggaacattggtctgggcaaaaaatttcccgagtaatgcctccaaatcacaggcaatcaaagcaaaaatggacaaatgggatcacatcaaattaaaaggcttctaagcagcaaacgaaacaattaacaaagtgaagaggcaactcacagaatggtgggaaatatttgcaaactacctatctgacaaaggattaataaacagaatatataagcagctcaagcaactctacaggaaaaaatcaagtagtctgattaaaaactgggcagaagatttgaacagacatttctcaaaagaagacatgcaaatggcaaacatacatatgaaaaggtgtttaacatcattgattatcagcaaaatgcaaaccaaaactacagtaagttatcatctcatcccggttaaaatggcttttgtccaaaagacaggcaataaaaaatgctgtcgaggaaatagataaaaaggaacccttgtacactgttggtaaaaaggtaaattattacaacaactatagagaacagtttggagattcctcaaaaaactaaaagtagagctaacatatgatccagcaatcccactgctgagtatatactctaaagaagggaagtcagaatatggagagatatctgcactccaatatttgttgttgcactgttcacaatagcaaaaatttcaaagtaacctaaatgtccatcaacgtatgaatgaataaagaaaatgtggtgcatgtacgcaatggagtactattcatccataagaaagaatgagattctgtcatttgcaacaacatggatgaaaaaactgagaatcattatgttaagtgaaaaggccaggcacagaaagacaaacatcacatgttctcacttatttgtgggatctaaaaatcaaaacaatcgaactcatcgacacagagagtagaatgatggttaccagaggctaggaagggtagttagggggtgggagagtgaaggtgggtatagttaataggtacaaaaaaatagaaaaaatgaataaaatctagtatttgatagcacaacagggtgactatcatcaataagaatttaattgtacattttaaaatagctgaaagaatataggccgggcgtggtggctcatgcttgtaatctcagcactttgggaggctgaagagggcagatcatgaggtcaggagatcaagaccatcctggccaacatggtgaaaccccgtttctactaaaaatacaaaaaaattagctgggcgtggtggtgcgcacctgtattcccaactactggggaggctaaggcaggagagttgcttgaacctggaaggcagaggttgcagtgagccgagatcacaccactgcattccagccttccagcctggcaacagagtgagactcagaaaaaaaaaaagtataattggattgtttgtagcacaaagaataaatacctgaggtaatggatacctcattttatgtagtgtgattattacacattgcatgcctgtatcaaaatatctcatgaacacctaccacatacccacaaaaattaaaaactaaaaaaaagtggttagtcaaaagatgagaatagctaaccaatttctttacaataaataaataattaagtaaaagtcagaacagtcatctcaagcacagtttcacttaagtacgctttaagcaaaggcctttgagaaatatgattctgttggcaagtccatccgtttttggaggtggatgcaaaatattcattgaacgaattctgcaaatgccagtgccattttttatgaccatctcatttggaggaaaggaatgcaacaggttattttagtttttgcattaatcttaaatttactttctatattccaaagctgtgatatccatacaagcttcagattttgatttagcttcccttatgtgtctgtctagatcaaaataacactggtcatgtggcattatgattaattagcatcattctcatgagtttttttttaatatgagcccactaaacaaaaagaaatctgcttttagtgtgaagacaaaatcagatttcaaatctataagtaagaaagctatattctgaactatggaaaatcaccagacaaataaacattagaagacaacccgttcctaacaagtgctctccctctgtctttctctctctgattcattatctaacttcctcaaattttatagtgtgtagttgataaacccttattttatagaactgaaatatgcatagataaatgtagtaaatcctatatctgataaggaatatttcctttggttgtcaattcagtcagtcctttcataagcttcatgagttctacataggtgattggtaatccaaagatcatgaccttatgtataatataggtatatatacataaaatttcctaaatatattcgctaaagtagagattacatgcaatatttctccctgtttgtagtctcataaactcacacagttgctttgtgatctggccattttaccattcatatatgctgagtgtttctgcaatcttgactaattgatgatattaaagtggaacagctagggaatcgtagatagctggatacagttgtaacctaaatttttctaagtctaaatttctcattttatatgtacagtatgattgagactcttgaaaataaaagatttccatgacaaaaaaaaagtcactcctagaaaaatcagaataaaatttatccaaggtgttacacaaaatgtaatcacccaaagggtctcccactcactcttaccctttagaacttattgctgtttcagatgtttttctttggaggaaccaaaactagaaaagttacatgataaattatatttaaatataaatttgttactaaaagctaaacaagaatgattctgtacttgaataatgatgaccacaatgacaactgcaataatgatgttgataaagctgatgacaatgatgatgacagtgacaaaggtaatgcaagtatattgtaataaattttaaaaaatactgaaggttatataataaaacatgaaactctcattcctgcctctaatgtctacttatcacctaaaatcacttttcagaattatctttctcctataatgtatcttgtatatcacaaatagatctgcttcattctttttaataacctcatattctcttaaatagatgtattatatttacccaatcagtactctgttcaccatatttgtgtgaattatagttcccagcatgtggcaataatgcgaaaaatatggttttataaacctgtgtatttgttatatcattttttgagtagtatgtctgtgttgtaactgaatcttgagaaatacttgcaacacatatgacaagagactcaatactttaaatgaggataagctgctacaaagaacaaagaaaatgaaaaaaaaactcaactgaaatatcgtaaaggagtattaatagattcaccaaaaaatcctaaataaatgaccaatatacaagtaaaaaatactcagcctttctcatctttaaataagtgaaaattttttaaaaaattgtgtttgtgtatgtgtgtttgtgtgtgtgtctatgtgtgtgtgtgtgtatgcatgtgtgtgaacttaacagattggcaaatacaaaaacatttgttaccacacagaattagtaaagtcttgtcacagcagctgtcttacatctctaatgttggagggcaggcaatgtaatgcaatctctttacatgacagcaatatctatatgaaattacaattagtacatttatattaaactttactgggactttaaatatgctttttggaggattaggacaaaaaactgtcaaaaaattgctggaatatgaaactcatgtcataagtatgtacagctgagctgtggggggggtgggtattctgttgatttatgtatgagtgccgcataagttcatttcaatcacattcagtttattcacttggtttcattctgaaggaatgaattcattctgatcattttgtctgtggttgagaaaattgaactctaacagattgcagtcccagaagaaattgcctagtgttagagctgcaagtaattgctaaactcccacgtgcctcaggggagaaagtatgtccttgattagaaaaacatgcaaggaaaaagaggcagtaagctcatagttaatgggcaagatagcattctgtgttaagtgctttagagcaacaaggcatattcttctccattttttactaactagaggattaatttatattgcaaaagaaatgttaaaattctaatcattcttcatcattaaataggaattctatgtcttcttattaccatacagaaggacattttaattcaaatgaggtagataaataaatacatccaagggacttatttaaattcacttaatgtatacttctaaattacatatttctgacaatactgacacaaattaaacaggatattttactatccaattatgatgaatcctacagtcagaaaatcaatatgctttagcaatataagcacttagactctttctgctgtgcaagagacaattagttccatgtctttgaagaagaaaaaatatacgtattttgatttattcacataattttagatcagattttgatgataaaccgatacataacttttgtcaatttaggtcatcagagtgtatatattaatttgaagtcacttaatataggaccagaacagagttaagtttagattgtgtgtgtttgtgtgtgcacgcgcatgagattgacccttgaacaacatgggggtaggagctgttaaccccagtgcagccaaaaaaactgcatgtaagttttgataccccataaacttaattattaatagcctactgttgactggaagcctgatatcatagaaaatggattaactcatattttatattatatcatgttatatactatattcttacaacaaaataaggtagagaaaaaaatgtcattaaggaaatcataaaaagtagaaaatttatttaccatgtggaagtggatcaccataaaggtattcatcctcattgtcttcacattgagtagactgaagaggaggagaaaaaagaggtcttgctgtgtcacaggtggcagaggcaaaagaggtggaggaggtggaatgggaggcaagagaggtaggagcacttgatgtaatcgttattgaaaaaaggatgtgtataattgggcctatgcagttcaaatctatgttgttcaggggtcaaatttagataaatagatagatagatagatagatagatagataagatagatagataatgtagatagatgatagatagatagatgatagataggtagatagataatgtagatagatagacagacagacagacagacagacagacagacagacagacagatagatagatagatagatagatagatagatagattaggctttagcataaactgatgcataatttttctggcagcctaggtcatcaagccatacatattagtttgaagtcgcttaatatattgactagaacagagttaattttagagagagagactgtgtgtgtgtgtgtgtgtaagctcagacataaacatacagaagtgaaattgttcacaaatattactacctgccccttgatacattaaagtgtaaggtacttatacagttggacttcatgtaaagcaagttaagctttttacagccttgtgattgtgccttaacctaataactctcaaaggaaatagtggatataacttaaatgaagtgcccttctaatggtattatttttcagtaaggtcaagaaaaggttacgtatgtattatagtgggtgcatatagagttacatctatatctactgaaacagaaataaaagaaatgttttggttaaattggagactaaatgaccataactttcctgtggaatgcctcaataattaaaactaagacttctttgttattctaagtattgattcttgcaaatatttttatttaaaagaccaatattgcttagtacattgtacataatacttcatgtgattcgttccaaaaacaaatacaccaggaagaaaatagtattacatttctttttcacagtaagaaaattaagctttattgatagtagagaatttcctcaatcttgtagaactggcaaatgagaaagtgaattttatcaaaatataatgtaaacttttccaagaaatataaatgcaataagaaaaaatatattaaaaagttaacaacaggatataagactactctattttttcaagatcttaaatagaaacctagccttgccatagtattctttcatgtctgctatccattttgagaatcatggaaatattaaatgctttaaaatacaaaattgatacattcaactaatgattaaataaacccaaggctttgtattacagtcatacataattttatcacacttcacttcacttgtagatgttacttttttttttacaaattgaagagtttgttgcaaccctccattgaacaattctatgatgccgtttttccaacagcatgtgctcactttatgtctctgtcacattttggtaattctcacaatatttccaacttttttgttattattatatctgttatggtgatctctgatcaatgatctttgatcttcgatgttatttttgtaatcgttttagggtgacatgagccgtacccatataagacagtaaactttgagaacaagtaaaactttattaatatttgttctcactgctccatcaaccagctgtttcccaatctctctttctcttgggcttccctagtacttgacatacaacaatattgaaattaggccaattagcaaccctataatgatctctaagggttgaagtaaaagaaagattttcacatttctcactttaagtcaaagctagacatgagtaagcttagtaaggaaaacacaccaaaacccaaaacaggctgaaaggtaggcctcttgtgacaaatagccaatatgtgaatagaaggtaaaactttttgaagggaatgaaaagggctactccaatgaatgcattaataataagaacattaaacagccttattggtgatatgaagaaagttttagtggtctgggttagaggttggctcatgaagtttaagaaaaagtcatctccataacataaaattgaaagtggaatcagcaagttctgatgtagaagctgcagcaagttatccagaagatctaagatcattgatgaagatagctacactaaacaacatatttttttctctcaaataaggtctttctctttcgcacagggaagagtacagtggcatgaccacagctcatacagcctcaaccccctgggcttaagagatcctcccacctcagtctctcagtcactcaagtagctagctgagtcttgcaagtgcatgccaccacacccacacacccagctatttttttttttttttcagagatgtagtattactatgttgttgcccaggctggtcttgaatttctgcgctcaagcagtcctcccactttggcctcccaaaatgctgggattatgggtgtgcaccatcaggcctgggccagatttttaatgtagaagaaatagccttatcttaaaagaagatgccatccaggactgtcatatctatgaaggaaaagtcaatgcctgaattcaaagcttcaaaggacaggctgggctgactctcttgttaagggctaatgcagctaacgattttaagtttaagtcattgctcatttaccattctggaaatcctatagctcttaaaaataatgctaaatgtactctgcatgtgctgtataaatggaaaacaaaacctggataacagcacacctgtttacagtgtggtttattgaatatttaaagtccaccattgagacctactgctcagaaaaagagattcctttcaaaatattactgctcattgacaatgttcctggtcacccaagagctctgatggtgatgtacaaagagattaatgttattttcatgcctgctgacacattcgctctgcagcccattgatcaagactttcaagtcttattatttaagaaatataattttaagactatatcttctatagagagagaatccactgatagatcaaggcaaagtatattgaaaaccttctagaaagaattcatttttataaatggcactaagaacatttatgatttgtgaatggaggtcaaaatataagtatgaataggagtttgaaataagttgattccaaccctcatagacaattttgagactttcaagtcggcagtggaggaagtaatcgtggatgtggtaaaaatggcaagggaactagagctagaagatttgactgaattgttgaaatctcatgatcacacgtaaatagatgaggaattgcttcttacggatgaacaaagaaagtgcttttttgagatgaaacaaactgctggtaaagatgctatgaacagtttcaaattgacaacaaaaaatttagaataaacataattgataaagctgtggcaggattggagaggattggttccaattttgaaagttctattgtgggtaaaatgctatataacatcatcacatgctatagagaaatctgttgtaaaaggaagagtaaatagatgtggcaaacttcattgttttttgattttaagaaattaccatagccactccagctttcagcagccaccaccctgatcagtcagcagacatcaacattgaggcaagaccttccaccaacaaaaaaaattcaactcactgaaggcccaaatgattggtagcatttttagcaataaagtattttttaattaaagtaggtatattggttttttaaatgtaatgctattgcacacataatagactacagtgtagtagaaaacataacttttatatacacagggaaattaaaaaatgtgtggttatctttattgtgatattcactttattgttgttgtctggagcctaacccacattatctcctatgtatgcctctacttaaaatttcaaagacaaacttatttcacatttttaatcacttagaggttttggtatataagcaatggttataactctggctaacttcataaaaagggcttaaatattcggaatctatcataagttctcaggatttatgggagacagaacaaacaggtaccaaggaagctccagaagcaacagtcctacttttattgttactttctttccatatagacacaactgttttagaccacaatttgcttaaagtaaccaaggacagtatgacttttatagcaaatatgtaatagtaataattaggacaaggaaataatcaaaataataagagctaattataattatattttactatattcaacactctaaatactctccgtgaattatttcatttactttttaaagaatgtatgaaaaggttattatcccatgaataaattatctgtattcttgggtatcaagttttaccaccttggaagaaaaaagttactcctaatttaagctatgggtcagcccgttggctatgcttggatagagaatgatagaaactgtcctctctggcttctattatgtgatacagaccttacctttgaccaaaatacaaaatgggatgagtaaatactattggaaagaggtctttttacgatggaaaaaaaaacatatacatgtttactataattaactttcaagttattttataatttttattaataaatctattgatcagaaagtagaggaaatgtctcggttaactttatgtgctcatcactgtattaataaatatctatagaataacatatgagggagaaagaaggacaaaaagtcaaggtcttgaagcacctattatttacacagggcacttcagctatttccttcagttataacaatcaacttataaggcaaatttattatccaacatttgttgacagtaaacatgattggcaacatgtagtaaaattaattttcttgcctcaagtcactatagggcagaattttgaatccagcaagtctgtatgaaggagtgtaacacatgatatattactactaagacttaaatgcttcttgtgataacaagatacacacacctgcaatgccaaccatgtcactgtcataaatatttttcatatcttgttcttcattaacattagcagcagcttgttttagttaactttccatatttttctcccaccttttcaaattataaagaattcatctttgtagccttttcttggaaaaaggtggaggcatgttatccgggccccacctatcatattcaaataagtgagacctttgttttgattctgggatttgttcagggcaagtaagcattgccttttccagaatagcctcaatgtttttaaaacattgtccctgtcagcatagacttcaaaacagacactttggtcttccaaggttttctaaactctctaattatctatctatctgtctattatctctatctatctatctatctatctatctatctatctatctatctatctatctaatttgtccacctatccatttccctcaaatgcttaaatgaaatacaattggttataatatttgctactaagaggctgggttagtcaagggaaagcacataattgagtgctaaacttcatgatgcacactactaagaattgccaaacctgaagggaaagtgaaatgttaggggaggtttcacaacagaattgaaaatttactggatctctgaaaaactggtggagtttaggatggatcccaggtaaagaaaaaaaatggatcccaggtaaagaaaatattatgaaaagcaaaaatgtaaaatttttataattaatgtataagcaaatgtgcctaaataaaaatcataaggatcagtgtaaagtataatctagaattaagcttaataaatgaaatataaacaaatttgggagactctaggaaagaaaatttagcattgatatttatgaagtacaaagttaactttagagagcttgacaaaatataagaggagatacaatgtagtgtaacaaataattaatggggatcgggagtttttaagatcatactaagtattacagaagtcatgggacagtagttccacttatgtgagctattatatccttatctgagaaaagaggatgtcatgtaacacaatctagaattccttttcaatgtatgatgctgtgattgaagttctcttaaaggaagattagtacaatagaataaatggatataagtagaggcaagagtcattcaattcatcactgtgtttgttgtaatgatcctacaacaaggtccataagtaggccttactttccattgatacacaaaatgggaagactgaatactcttagaaagaggatttgtatgatgaaaaacaaaacaaatatgtgcttgctgtgatgatcttagacaaggatagatacagaaggattaagaagaaggtaatgtaaggagaaacctacattttttgtcttactggataaattaaaatatgattttattgcaagacagggaatttgagggagagaattaatttgcatgaagattgtaaattttaacataagaatatcaattctgagaattggattttttagggctattttaattggaatgttcaacaaataataagaaaataactttcatttatttcatgctaggtttaaaaattgtttttattctttattttttaaatagggatagggtctctctattttgcccagctggttgcaaactccagggctcaagaaatcctcctgccttagccttccaaagggctaggtttacaggcatgagccaccacacccagccttatactagtttttataataaaatattaatttcccatttatagtacattctttagcccccatagaagcaagacagagtcctcaatatagtctgttatttcaaggaatgacattattattccctaaattatgaattgccctagaatccccaaatggcacaagggaaaaacaaaaacaaaaacaacaaccactagaccatgtcatccttttaaagtgtttcatttgattgaaatactcttgatatgatttggctgtgtccctgcccaaatctcatcttgaattcccacatgttgtgggagggacctggtaggaggtaattgaatcatgggggcaggtctttcccatgctgttctcgtgatagtgaataagtctcatgagatgtcatggttttataagaggaagtttccctgcacaagctatctctctttgcctgctgccatccatgtaagatgtgacttgctcctccttgccttctgccatgatggtggggcttctgcagtcatgtaaaactgtaagtcctttaaacctctctcctttgtaaattgcccagtcttgggtatgtctttatcagcagtgtgaaaactgactaatatggtaaattggtaccagtaaagtgggaactgctaaaaagatacccaaaattgtggtagtgactttggaactaagtaacaggcagaggttgaaacagtttggagggctcagaagaagacaggaaaatgtgggaaagtttggaacttcctagagattgttgaatggctttgcccaaaatgctgatagcaatatggaaaataaagtataggctgaggtggtctcagacggaaaagaggaacttgttgggaactggagcaaaggtgattctagttatgttttagaaaagacactgacagcattttggctctgtcctggagatttgtgaaactttgaacttgagagagatggtttagggtatctggcggaggaatttttcttttcttttttttttttttttaattgaggtggagtattgctctgtcacacatgctgaagtgcagtggcacaatcacagctcactgcaacctccgcctcccagattcaagtgattctcctgcctcggcctcccaagtagctggggttacaggcacatgctgccgtaccatgctaattttttgtattttagtagagatgggatttcactatgttgcccaggctggtcttaaactcctgagctcaggcaatctacatacctcagcctcccaaaatgctgggattacaggcatgagcctccatgcctgacttggcaggagaagtttttaagcagcaaaacattcaagatgtgacttgggtgctgataaatgctttcagttttataagggaagcagagcagaaaagttcagaaaatttgcagcctgacaatgtgatagaaaagaaaatcccatttttagaggagaaattcaagccagctgcagaaatttgcataagtaacaaggagctgaatgctaatccccaagaccatgggagaaatatctccaggacatctcagaggtcttcacagaagccgcttccatcacaggcccagaggcctaggagggaaaagtggtttcatgggccaggcccagggtccccatgctgtttgcagtctagggacttggtgccctgcatcccagttgttcaagccatgactaaaagaggcaaaagtacagcttggaccacggcttcagagagtgcaagcctcaagccttggcagcttccaagtggtgtggagcctgcaggagcacagaagtcaagaattgggatttgggaacctctgcttagatttcagaagatttatggaaatgcctgggggtccagacagaagtttgctgcaagggtggggccctcatggagaatgcctgctgggcagtgcagaagggaaatgtggggttggagctcccacacagaatccctctggggcactgcctagtgtagctgtgagaagacagtcactgtccttcagaccccataatggtagatccactgacagcttgcatggtgcacccagaaaagccacagacactcagcgctagcctttgaaagcagccaggagggaggctgcaccctgcgtaaccacagggttgaagctgcccaagaccatgggaactaagctcttgcatcagcatgagctgtatatgagacaaggagtcaaaggagatcattttggagcctaaagatctgatagccccaccagattttggactttcatggggcctgaaacctctttgttttggccattatctcccatttagaatggctgtgtttccccacacctgtatccccattttatctatgaagtaagtaacttgcttttgattttactggctcataggcagaagggacttgccttatctcagatgagagacattggactgtggacttttgagttaatgctgaaatgagttaagatttggggaactgttgggaaggcatgattagttttgaaatgtgaggacatgagatttgggaggggccaggggcagaataatatgaattggctgtgtccccacccaaatctcatcttgaattttgagagggacccagtgggaggtaattgaatcatggggacaggtctttcccattctgttcctgtgatagtgaataagtctcacgagatctgatggttttataagggaagtttccctgcacaagttctctcctgcctgttgccatccatgtaagacgtaacttgctcctctttacctttcaccatgattgtcaggcttccccagccacgtggaactgtaagtccattaaacctctttcttttgtaaattgcccagtctcaggtatgtctttatcagcagtgtaaaaatgtactaatacaaatctttattatttattttgtatttctagcatttatgtaataaaattatcacaatcaggtcacttttgtacttagactcaaagtattagaaaaaaatcttgaaatttatatacctaagaaacattttttttactgtaagcatatatagaagatttgtgattatgttttgaaaacttttattttacatatgtatgtatgtatgtatgtatgttttatagatattatatttgaggctggtctcaaactcctggtctcaagtgatccccccaccttggcctctcaaagtgctgggattaaaagcaggaaccttccctctctgcctgaacattttaaaataagtatttctaactatagattctgaatcactaaagggaccttgagagtctcatagacctaattataatcaccctgaagagatagttttcttgttttttagattttcagggaaaaaatttacaaattgcctttatttatttgtgctaatactcttggatggcataaaattcttgtatacacacaaaaatgtctttgttcttcgagttgaggccagttacttttttctgttctcagagacaactaagagttattaatcactaaccttcataatattgtccttcaaataaaggtgattatgagatcattatttttatgatggaataaataatactaatttctacttctatccccataaaaatctgaagaactcataagaattgtcaatagacatattagaaaccttccaacttcactagtcattgaagtatagtaaattacactgaaagcaagatgtctgttttcactatcaaaatggccacccctcttctttttttgcacattcacagtcaatgctgataaagatgtagtaaatacccttgaacctctgaggtgggaagtatgatattattgtgcaacctttctagtaagcaatttctttaaagttattcatcattgtctctggttccacttccagggatatgagttgtcttacatcagcttccataacacttacattttcttaagtgcatgtttgacttaaattagaaatcaagcctgagaagagatttggttgtaataatttattgactcttttgactttttaattatggccattcttcaagagtaaggtggcatctcattgtggacttaattttcatctggatgtggtgaaacgggaacaatttacactgctggtgggaatgtgtaaactaatacaaccactagggaaaacaatatggagattccttaaagaactaaaagtagaactatcactcgatccagcaatcccactactgggtatctacccaaaggaaaaaaagtcattatatgaaaaagacacatgcacacaaatgtttatagcagcacaattcgcaattgcaaatatggaaccaacttaactgcccatcaacgaacgagtggatgaagaacatgtggtatatatacaccatgaaatactacttagccataaaaaggaataaactaatgtcttttgcagcaacttggatggacctcaagaccattattctaactgaagtaactcaggaacggaaaaccaaatatcatatgttctcacttacaaatgggagcaaagttataaggatgcaaatgcataagaatgatataatggacttcgaggacttagatgcggaagggtgggaggggattgagggataaaagactacatatagagtacagtgtacactggtcgggtgacaggtacaccaaaatctcagaaatcaccacgaaagaacatccatgtgtccaaaacccacgtgtaccccccaaaaatttgaaataaaaatataaattagttataaaataatactaataatttattgactcaatgtaggaagagaaacagtatgggaatagagaaagagccaaaagggggtaaagattcatctaaggtaaagtctgtacctggcgctcctgagatgccatcttagctgccagtaccaggagctggggaagggctaaagttgaacattaggaaccaacactcatatttacggggagatgggcacattggcccaataaagaggattcagtcagtataccaaaacagatctaccgcatagttttggaaataatcacaaatgtgtacttaagattttgtgtatagatggtcactacactgttaacactaattaaaaattggtttttggttcttatattgttttttcttttaagtagtacaacttttttagttcagtagtataagatctctattaatttggaataaaggataaatggaagaaaaaaatatgaaaacaagatagactttcatctcacaaatttagttattaagctgatatttttaaattaaattgctaatatattaaattacacaaaaacgaagaatttaatatgtctcatatttgtgttgttttgtatcagagccagacacacaatttgaatgacccagtgcaaaatgaaaatgtgaaaccccttgttaacaattattaagaatttcaaaacagcaacagcagagccataaaccatgatgaccttttaactgtggggactgtttaactgcacagatcatatgcccacaaaatctgtcctgccctgggagcagactacaattttaaatggagaggatttcaattttgatatattgccatgtgctggtgatgatttcttatgttagataagtacctgcatatacaataaaccctttagattctaaatttgtggcagtttcccatttcatttatttattaaatgagaagataataaatttaatattgtaataaaagatacgtttggagaataaataacttataaacttatatttaaaagatatccacaatttttaaaagttgaaatatttttggaatgtatacatacagaatttatgcttctttaccctgcaacaataaaatacaacattccaactcaaaaaaatatataaaaggatggcatagggagcaagaaagtgttttctgaaattaagatgtttatcagttctcgatccatgaataacataatcaatgactaaccataaaaaataagaaaaacttcagacagtttgtataagtcaacaggagaaactcaaaaaacgtggggaaagaaatatgctgggctgtgttttatcagcacaagagcaatgagtcatttaggggatgctggaatctcttgagtaagatccacttgacaaagcatttatgccatctgatgtcactgtgactcatgacgaaactattatttttgaaaactggcttgttttctttagcatgaatcactaacttgagtttttaaaaatatgttcatcttctagccacagtagaaacaaaattaattttgaggaaggtgagaatcgagtagccagggtgcttatagtctcaagtcaggtaccaggaaggaaaagctctactgagttcacacataaaaggtagctgccgattgtagacaattttgcctcctctggctccattctctaacagagtctatatttttccaccacccaatacctatcgatttataacattaagccagaaaacaaaaagccatccttcccctataagacgagtaataagcattgataaaatcatttcatggatagaaattttgttaaaagtttagcattgtgacattttagtccatctgcaattttctactatttattctgaaactgtctgtagacccagttttgattctatttaatcgttatggaattgttccactcaaatacataaggctgcacacacatacacacacacacacacaccatgctatttatacaattacattaagggattccacttatgttgaaaataacagtgttactgttaacttgtgtcttcttatgtataacagatggtttacatgttgttttttaaagagtagatttgatataaaggtagctatgagactgtacaactccctctgtgagtactgttgattttgatgaattggttcttttttctcccaaatgacaatatgttcaaacagctgttgaacattcaaccaacaactattagggtgaccctaccctctgaggatgtatcatcttattctgaaaatattcattcatctttttgggttctcacatcataatgaatgcatctgttataaattaatattataaaattaatatttgtggaattataagggcttctacctctatagtaaagatatgtatttttaactttttgaagactatatgctacaagaaaggatagtttcatgaaaatattgagtaaagttaggaaatgaatagttatgaatgcaaaaacattagctaaactattttctgagcttttacaatgtattagtagttttatatatatgagttcattttattttcttaaaaactcctatgaagtcagcaccattgatatctctattttaaggatgaggaatctgaggcttgaataattttagtaacttttccaaagtcccatagcttgaaagtgaaggagaaaagatttgactttaggcctcagcacctacggacttatgtattacattattatgtaattcagagccccctttagttattaattcatattttaaacatttattatattggcctgtgatgtagacaggtatgctagaagcatattagaaaatggtttgcacatagtatgttttattgcatcatgtgagtcctcacgagcattgcagaaatttcatataggaagcaacagcactaaattttattatcatcttaacaaaaatttaacttgaaatttttatagaaagctaaatctgataggcatccattgaatggataaaggacatctattccaattatggaaattaagggacaaaataaagacagagagaaaatacttcagtatttttaccaaaatgcaggttagcatttcacttttttgttggcttaagtctcttctacctccatatataagttgcactttgaagacaagtatactaatgttcttgtgttatgttctcagtgtctacctcagtatttgacatgtggttaatttacagtaaatacatacaaagcagggaggcagagaatgatattgtttggctgtgtccccacccaaatctcatcttgaattgtagctcctgtaattcccacgtgttgtgggagggacccggtgggagataattgaatcatgagggtggtttcctccatactgttcctgtggtagtgaataggtctcacaaaatctgatgattttataaggggaaactcctttcacttggctcttcatttgctctttgcctgccaccatgtaagacatacctttcgccttccaccatgactgtgaggccttcccagccatgcagaactgtgagtccattaaacctctttttctttataaattacccagtctccagtatgtctttatcagtagtgtgaaaatggaataatacagagaaggagtgaggaaagaggtggaagggaaaaaggaaggaaggaaggaaggaaggaaggaaggaaggaaggaaagaattaaagtaggaaggaagaaagggtagaagaaagatgtaacgagaataagagagaaattatttaagaagatattaaaacaataatagctattatatgaggagttagaaaaagagggctttaaccataaatgaacagaaacttttcttaagttcacttcataacatacagcatatttgagaaataattagaagttgtgataatttcaccatgtcacatggaaacttatctcgttatgtttaattcaaactttgtataattatatataattcctaaatagccctttacttttaaaagtgggtaatgatataacaataaaactaatttattcaggcatgtttatccccacacaaaatcttttaaacaagttttcaagaatctgaatttcagttataacagctgtcttttctattacttaaacatactttgtaatttttttcttaaagtaaactaccataccaagaaaacagaaacaaaaaagcaagcatgctaatttgtacacttagaaattaaagtagaagctattcttggagagggagtggcagtagctgatgggtgaggagcataagggaagattctggctgttggttatgctctgtttcttgatctgggtgctgattatattattgtttggtgtttgtgcaaactaccaagctgtatgtttttctgtatgtatattatacttgagtaaaaagtttaaacttttagagagtcaatcttgctccatgttgtggtttgtgcaaacatcaaggcataatcacagaacaaaaaaatttaagacccaagcttcaatcgcaaagctgacagatttctacacttaggctcttaagcattattcttgtgctcttttcttgtcctaagcaatatttactgtacacacagctaaggaagtctactccttttactctgtcactataatatgctttagctagacttatttgatgtcttagatcagcatcagttttagattattattctgtgtatgaatggttaaagtttagtaatcatgttacctaaatttcaaaagggaaaatattgggcttttacaaaaatgtactttcaaatcaagtagttttgttgtgtttctgaaaaggaaagagcaaacaaaactagaaattgtgctactgaaaaggaaagagcaaacaaaactagaaattgtgctattatttgcttcaatttatccacctgagattagttaatctactcataatgtaagatgtgttgtttcaggcagataactatataatatgttggtatgttgtattttgtttgttactattgtgaaaaatagtcccactggttttccaaaagatacagtaaactgcccactaattgccaaaggtgtttataaaccatcagtcatcccatacaggaggtacatataaacattaaacaggacaaactattaatttactattaattaaaactactgaatttgtgccaaattaattcaaataaacataaaaattaagaaataaaccattttggtggacaacagtgcaattttagtttatatattaactactgcctctgcttcatatgttggccctacctaatattatctttttttattccttttggtggtgttcattaatctttgaaagcaaacatgaaaaaatataaatcatctcatttagtatcttgcccttgcaaaaaagatagtaactttaaaatgaaaagcagtaaaagggtaaatgtactggcatgctggatctattcagctcttcaattcctttcccttctgaaaaatgaagggggtaaactcattgagaagttattaatagtttgccaattgattcatatgtcattgcactatacaaaatttgtagaaaggagaaaaatggctttaatatatttgaatgctctgtgcaacaaatgtcctattcctctgataagtggtagctgtcaactgatgacagatacatgccttataatagggagatgccagttaccaagtgaaagataatgtttcatatatttgaaagttaagttgagatggggataagacactagtttacctagacttccactgtaaacaaaagtatgctagttttgggagagttcgggtattccctgcccttgaaatatgcagttgattcttcctacctcctagcactatatactataatctaagctgttgtcattgtagtagtgatagatttgctctaataatgaaaatgaatttgctttaacccaatcatggtttctcatggtttgtgacaacctgcaattgaaactgacctcagaatgggaaaaaataatcaaatgttgtgctctttttttggccaaaggacttcctctgccttagagcacaatttttttaaaaaacagacatcaagaagaaaacttgtaattataattattacaaaaaaaaaagctcagaaagacaaatttgaagcaaatataacaaattacaacaaactacacagagttcattcttaaacaccttatataagaatataaattcaataaaatttgaaaaaatagaaatatcatgtcaataatttaaaacattgatactacaagagaaagcaagaattttgtattaaaacttagttttccctcacctttagtcctaacccctttgttccttttccatgactaacagttctgatattatttcctttctgaattgtaggttgccttgcaattatcttcaaaatttgaagaagtagattatgctgtcagaaatacatagcatattttgttagtcttgattagtgattttttcctgataagtatttcaaaagcctaaaatgctaagttgtgaggttttctgagagaaaataaaaactcatctcttggaaagtcattactttataaattgtttttattcaaacaatggaagataacataaaaatcagctgaaacatgaaataagaggaaaaaagtgcaagaaataaacactcaaggtgagcctcaacaaatccataacttaatggaaacctaattttacatacttatatatgtatgggtagcatgaatattttgatgattttgcagtgtctaattctagaacgttcttgtttcaatactgtttctacttcacagtttattattaggaaatttgatataaatttttggctaagttttatactcttctcttccaggtttctttttcccttactatcctttctgaaaatttatgttaaccagttattttaatcaggaggaatttcatccccagaagacatctggcagtgtctgtagacgtttttgttggtcataatgggggatgggaaggttgtattctctattgatacaaactaatgatgctgttaaatagcctacaatgcataggcaagccccccacaacaaaattgccgggctttaaatgcctaacaccattgttgagaaaccctgatctaaaccatgatggtaaaataaactctgtaactgacccattgtttatgtttttttctaaacaaacaaacaaatgttctcagtatttcaatagttcttgtgttggttacctgttgtggtataaaagccccaaacagtagcttaaaacagtagcaatcaattattttgttcatgaactcagcagttgagtgggctcagcatgtgagtgtttgtctcacctgtgtctttcatgcagcagcagtcacacaatgtctgaggatggggttatcttaaaaggcctatcacttgcatagccagggcctgggctagaaagaattaaacaactagtgctgaaacagtagaggctgcatggacatctcctctctgtatatggtttctttacttgatctctctacatcaggggtccccaatcccctgaccatggaccactacccatctgtggtctgctaggaaccaggctgcacagcaggaggtgaacagcaggcaagggaccattaccacctaagcttcacctcctgtcagatcagcggggtcattagattcttataggagcaagaaccagaaccctattgtgaactgtgcaggtaagaaatctaggctgcatgctccttatgagtgtctaactaatgtctgtttatctgaggtgggtcagtttcatccccaaaccatcccaccccctccatggaaaaattcttttctatgaaactagtccctggtgtcaaaaagtttggggaccactgctctacacggtggccttagggtacctgggtttctttacatgatggttacgttcttaaagagacaatgtcctcaaaaagactggcacaagctgaacaaatgtttctctaaagttgcacagtatttttctaccatattctgttcttcaagttagtcacaatatcctgtccaggttcaaggaaagttaacatagcccctacctcttaaatgaatgaagattgtcaagaacttgagggcatggtccaccttcgtatcacaagtacttatactttcactacgtgcaaaatacactcactccctctcaagactttcaaatgtctcatatattgtaatatcacactcaggtttgaggttttagtatcctgttatctaaatgagatccatgcacgtaagaagctctgtgcctgtggttgtttcagtacagctccttcagtgctgtttctctcaacctgtagatctatgatctaaagagacaagttatctgcccaccatatagctaacatacaatgatggctcacatatagaagaactgatacaattccattcaaaataggtaagatgggaggcaatcagagtcactgattcatagcaattctgaaatccagctgagtacatgttgccagtttcttgatgatggctcagtcttattgcctaggaatgatttatcatacctctttggtctgccttctgggtcttgattttgttgtctgaatcatccttccttttacataagaagtgactggtgtttgcagctgagtgttcgcagctagctttctgctcacagaaatcctgaaatccaacttccttttaaatttatactgtccctgttcttgcattcccacctgataaaatttctttaaaactatgtgggttttcaatgaattaatgtgcaattctttctattagaaaaaatacacactcacagatctcaaggatgttgtggggaaagtctttgaagttattagatctcctgttattttacagagattatctgtgaggaacaaccttggcatcattaaaagacttcttgactctttgagagagtctacaaaacttaaccttaggtcttttgggatccttaacagagggctatcttgaatttgatctttcattataaaacatgtcttaatttaaaaatattttgcaaatgagagagccttggactgagaaatattgtggtggtggacaggtgggggaaaggaacaaagaaattctgatttctttccattttctctaaatatgacttaagattaaatgtaaacttttccaactttcttgctttgttatctctctacatggcatcctcagggttgctggatttcttggtagctaaagtctccgaaatcatgtgttccaagagagacctacagaagctgcatgaccttttataatctagcctcaaagttatgcaatatcaattattcttcaatgtatttattgagacagtcctacaaagccctcaggttcaaggtggtggaaacagacttgacctcctaatgggaaggagagtcaaagagctggtgacattttaaactactgcaatgttctatatgttatgtttattttaaagtactaccccaattaggtcctattaatattaacatctatatcatctgttcatgattcaagtttttcccatcatgatctagctccttactccctatatctccttttaaagtctcactcaatcatccaacaaaaattattaaagatggcttacctggatcaggagcaataagaaaaaaattaaatacaggacatgatttacgaccttaaggcactcataagttagttgaagaaaattctaaaatatgaaacacaattctagactatcaactgatataatagcatgttaaaaatgaaatttggatttagtcattataaagtagaggcattgtttatagaaattcaagaagataattaaaatgaatcctctcactcacatcaaagatacatggtggttgagagttgggaaataataaaccataatatttaaggaagatgtctttggagagagctgagcaataagttgtatactctgcccttcctcatactcccacttacatactcacatgaaaaaatggagggtaaaattaatcccaagttggtgagagaaactttgaccaatcaagaatctcatatgtgtttgctgataggtatggggccaatgtagaatggttattgactcatgcttgaaaaactaaaggggaaacagagaaggtggcaagtgtgaaataatcagttttgccccagtgatgtgtcaaacgtgcaagaatgtgatgcaccatgtgtggatctagcaggaagcacactggcctgtaatcatttaaaaaagaatcttgtcaaaaagaatgaccttgcaggacctgaagattttagtcaaggcttgggtgcattacgtcaacatttgaggattaattagaagaaacataattaagagaggccctgcgcacaccaagagagagggaatctgagaaatttgagacagccatagaaatgcaccataagaaaaaaaaaagtagactagcgcaattcatctggctcagaaggcttggattcacctttaaaatgttcttatccactttcctctcttctttcccctaccttgaccgtagattcagaagaatctttggctagcaagtttagcatggattggggagctagggaagactgaactatcatttatctgccttacattacaaagtcccttagtgaggaggaggaaaacacttcaaatcaggttcagaatttgattattctatggggtggtttattcaaattttgcagaattgggactgtttttgccttaaagtgaccataaggctttatataacgtaagattgaacaaaaaaacacacgcagtttgccagagggtccaagctgggtccctgattgtttaagtctatttatgtagcacgccatgcttcaatgaaatctaatactgtatgttttaaaggaaaatattcaaatctgtgattgcgacatttgatgcaggtagaatggttagcccagatattattaatctcatgtcattcaatgatagaactgtggataatatttatttccctggtgttgctaaatcaccccatatgtcaagctcttacatcctagattaagcaaatatcaacataaataacaaggacagtaaatagaagaatgttatggctgggtgagcacttcagcacttttcagtcatattttagtaatggttctgttctcccagcagtgagctcaagaactagagaaatgaggatgacagcaggagggagggcactgttaactgtgcatgacaggaagcaagcatggagcaaaccgaaagagggaactgtagcattgctacaggccagagaagactctgagcatgcatcttttcccaaagatcctaaaggacagagtaaaactgagccagtgtccttacagcagttaaacatctgaagttgaggcccatcctgtagatgccaacaaaagattgaagatttataattctattgtggggccttttcttggtaatgaactaacttgctgaaaaagtaaacacacacacacattataaaatatatatattgaaatgctttattttcccatatcttaatacattttgtgaacacatagcacactatcaagaccacctcaaagactgacctggaggtcccaaagtatcatatcctaccaagtcaatagtttttaagggatttatcaacagtcaaccataaaataataacagagcttttgttaaaacagaatatattggctgttgttactaaaagattctacatctctattcatatctcagcattgctttactctgttccctcagagtagcaaataaaaacaaaagcagttacctaatttggtttattcacacacctcaaaaattaactctaggtcaaatgtctattcctcattctggctttggaggttataaagggatggaaactgggtccttactagttggtatacataaaattgtctgatacattttagtagggagcatatggtatgcatatggaaaatataggtccaccatatgctggtgttaaacccaggtgtcgtcctattaattatttgtgtttcttgagaagaatacagagacatatgtgcaatactggcattgaattcatgttcaaatctgtacaactattttatacatgatagccacatcacacaacatttattcagtattgtttatatcaattgactaacaacattgtctcttactactctgaattttaagaatatcaaacaactaatgttgctagtttcatcgttgttcctcagaaatttataaataaataattacagtgtatgacttcctacataaattccctaagccactgtggatgttatggaaataaaatgtctatcttagacaagaaacatttgttaagataatgtgttagttttctagggctgccaaaacatagtgccacaaactgattggctaagaacatcagaaatttattgtctcacaattctggaggccagaagtttgaaatcaagatggccctttgaaggttccaggaaaggatctgtttcaggcctgtctcctggttttggcagcctcgggggctctttgtctgtcgctggccatcttcttgctgtgtttcttcacattgttttccctctgagtaagtctgcatatctgaatttccccttttaataagtacctattatattgaacaagggctcactctagtgacctcattttaacatgaatacctctgtaaaggcactatttccaaataaggtcacattctatggcattggggaacaaatacatgagtttgggggggacacaagtcaatccctgaaggacagtctccttttccttatcattttttctaacagtttaatttttaaagtatttcaattaaaatgttaaagtgctattgtaacatttttcagttctctggagattgtaatacaaataaaatgtaacaactgccttaaatttcattggtaaataggcaaaaagcatgtaattaaactgtttctctctgaaaagatttctgaaattgtgtgttcacaaattgtgtatgtgtaagtcttgtttagataacaattaaaataggaaagcaaagtttttccttaatttgaacatgtatttgttcgatacaatacccatgcattataaatttaacttttataacatactgaaaaacttcaaacctgtataaaaaaacattttcatagattttaccatatatataatgtatatatcttttaagtatgaaatgttgcctttatgatttaaaattcattattaattatggttcaaaatagtttatggcaaatgagcactccaacacccaatgattcttttaaattcttgacttcaggatgcatacacctatttaatgatctcctcagcactgttgtgtctccccaaattgtaatgctttaatgatgcaattggtctttgataaaattataggcatctctaataattttctgaaactgatttttgctcaataacaagtgtttcaaaaactgggtcatccaatgctttaaatttgttgttattacttgcagagccatcttttgggacccctacctcctctggcctaccatattatatggggtatttaaacagcagcattatgtgtaggttgattatgatattttttcactaataataactattaataactacctgagcttctacataatagatgcagtagctggagtgacatattggttcattcatgtgacattcaaaatgaaaataagatgtgctatgtttgaaagacagcctttgattttggtgaaatgtcatgttataatgtcaacataagttatttgttaatttactgaaagcttaaaaatcaacattatctcttgaacttattcttcctatccaactctaacttttcatcctttgactaacattttcccaacattactgcacccaaagcaggccagcctctagtaaccaccattctactctgtacttctgtgctgaaagcggatgttaagtgttcttaccacaaaaatgataactatatgaggtaatgcatttttttaactagctagattcaaccatttcacaatgtataagttctttgaaacatcatgttttacacaatacataaaactttatctgtccatttaaaataatcagcatcacctgaatttaataggatctctcacagtgattaatagcttaacaactagtgttttgaaagtcaaaacatctgaatattatggaattgcctagcattttatttgctttattatatgctgtaaaagaaagtacttaaactgaggaactgacttccttagaagctagagtacaccagattttcctccttttccctattttttaatgaccagggagctgtgtgaaaattgttacttaatttgttctctgttagttacgtaccagttctctgaatctcagtgaagaatatcacatccttagccttaaacaacttgggtgaaagtgacaatgattttgagtcagaccagacaacattaaagactccacaaaaatgggataaacacggaggctaaaacatcagcgccccctgacatttttgttttgttttgtttttttggtagagaccgagaccttctctgtcacccaggcagggagtatagtgggcgatctcggctcactgcaacctccgcctcctgagttcaagcaattctcctgcctcagcctcccgagtagctgggattacaggcgcacgctgcctcgcccggctaatttcttttgtatttcagtagagatgggatttcaccgtgttgtccaggctggtctaaaactcctgagctcaggaaatctgcccgccttggactctcaaagggctaggattacaggcgtgagccaccgcgcccggcccagcgccccctttttattttgtatacaaccatgctgttgtcacatttgtgattaaaatacagtagacacaaattacgactttatagtaagatgctgaagaattctggcttttcaaacaacctttccaaatgtggaaagttgcattatggttgcatttttcctagacttttaggaattaactgctttacctctagaataaatatgatagaatacttatgaatattagagaaaatatacaatcacacttcaaatccttcacaaaagaatgtccagtgtctaaagactatggatcgtttccaattgaaactggagctccttcaaatgctcatctcaaaaattcagataattacaacagaaacatcatctatcatttgacaaaagacagtttaaaacattggaaatttgagcaagataatgtcataaatatagctatgtcttcctcctaacatttaagaaaaagtttattaaatcaggtcatcaggaagtcacatgaatacacattatctttatttcctacaaaaatgtttctctaacttaaggcataaatttatagagatggaacgtcaatatgcaggtgacaggtctgatagagatccaaaaatgtaaattgtccatttgaataacactgctgtgtaaatctgtggttgacaatacgatattacctaatatattttatatgcctaaactccttcttattcactggcatgaagaaatgtgtctattcacattaagcaaaaatggttgatttttttactggacaaagggaactatacaatctaaatgtttctcctatttttgccatacgttctagtaacacaaccttggttagagtacaactgtagtgaattattaattggatgtttgttaatatgtgcatattcctttctaatatttttgtcctgttcttattgtttttgtttaatatgcatgcaacatcaagtcgaattttattgttattaaaaaaagtgtggtagttacatataaagataaataagtaccacctgtattggtgattatagctaattattgacaatctaaaattaatttgaaaacgtagagatgttgtccacaaaggtgtaaatttttagatattatagcaaaaatatttcttctgtacacaagtatttgaacatacctaagagtctgcagaggacttaaaagtatattttccatttgaagtaaaatcctatggcctttaaaaactaagacgtgaattatattttaacccaccctaagttaaacatattgaaaggctctattgtaatcacatcttcaaatgtatgttttcttcattctcatctatgttgaacccttaacaataattgttatcatttatactgttaaatccaaattattccaccctagttgacactaagtgtttaaagcaaataaagtctcaacatataaaacttgatgtgcacttttaaaatagtatatagtacttacccatccaagtagaatgtaacagcagctgagaagctgtcaaggagaaaaatgccagaaggattaataaatcatattgctataacatgatgatgagaattataaacagctatgtaaaaattaggtcactggcagtcagatgacttggcttcttttagtggtggtagtagaggagtgtatatttatcttttgttatgccctggtaagtagctggcaagcttgcaatatataaacattatttaaagatgttatgattggcttgaatccaggaaatgttctcagatttaccattagctatcagagatcttaaatattgctagagaggatcgaagaggcaaaggaaagccagaagttaaaaaaaaagatattaatagtaaaaaagttaggaaataaagcatgcatacttaatgatacaaaaattttaaaacagtaaaatctaaatgttcacatagttcttaagaaagagtgattattaaagcatgttattgaaacaaagggagaagtgatctaaaacaagggcttacagaatactttttaaaactttttattattttcattattttatatacatggaaatcattgttcataatgtatttctataatattatatatgaaaagatctatgttgttattcacagccattacttgtaactttacacaaaagtagtgatatgaccaccagaacaaaaaaaagaaacaaacaaaaaactcacttaattctcaatcctcatgcaatttaactgaagaagctcttgagaaggccaagtaataacttagttgtgatgtactagatttactttggtgatttaacaatgctcatgcaattaatgttctttattgataaataagttttattcagataaaagttaactatatttataaaatcatatttccatagaaaaagtctatgaggagtgagatgtgtttacgcaataaatgagaaaagttttttaatatcagtccactaaaatgattctaccttgtattacataaattaataactcttgttatgaacatagattttaaaatgtagtcaagaagtaagaaaattaaggtcattttaattctaccttgtggagttattcattattaatatttgagtctacatgcctgtcttcttcccctgtcttattatagaaatgttggctattaaagaaaaacacaaagatatgtaagatacaaagatgtaaaaaatgaatgtttggctggttgcagtggctcacgcctgtaatcccagcactttaggagtctgaggctggtgaattaccggaggtcagcggtttgagaccagcctggccaagatggtgaaacctcgtctctactgaaaatacaaaaattagcctggcatagtggcgagcacctgtagtcccagctgctcgggaaaccgaggcaggagaatcgcttgaacccgggaggcagaggttacagtgagctgagatctcgtcactgccctccagcctgggtgacagagtgagactccgtctcaaaagaaatgaatatttattatactcccgctcactactgttgagtttgctgcatattaggccacacttttttctccgtacataccaatgtgttttaacattattgtctagtgtacaaatatatgtatagataccactacataattatgaaaatacactgttttctcacttactttttgtcttagcattatatcttagatgcctttcgatatcaattcaaatacacctacttatttaatgatcatatacttgtaataaaagaataagaaggattaattcacatgtagctttctagtaatagaataattctgcacttaactataactcttgattattaaataaggttttatagttaaaacataacaagactaaagtgattttgcaagaagacacataaaagatggtaaggagaattgatgttctgtgcaaatttcaatgatagatgctattatatttgctagcaccacagggtaagtatagtcaaaaatcatttaattgtacatttaaaataagtagaagagtatcattgaattgtttgtaacacaaaggataaatgcttgaggtgatggataccccagttaccctggtgtgattattatgcattgcctgcctgtatcaaaatatctcacgtaacccacaaatatatacacctactatgtatccacaaaaatttaaaaaaataaaaatttttaaaaaaaggaaataaacttttataactaataaagccaaacacttccttcactgaaggcaggtgtaaaagatttgattctgaatagaatagtgtgagattactgggagattaattctaaagattttcctaggttgatgctaagaactgctataagttattttccaaaattgagagggcatttgaaacttaggagctatttaaatattgtttaatttttatttcaactaacttatttttgtcaaatttatatgcatatatattaaatataaaaacaaaaaaaactgtggaaacaatcatgtattaaaaggatgatatgcatttgaagaatggacacttattctcataacaaaagccctgaaaaaatgttgtacaacacttcatctaatatctaagaaatcattcccctagatgggagtagagtatctgttccagttttttctaagttgttgactttttaatgggagatttaaaatgtttatacagacttcaattgctcttgttcctaataggcaccatcagaaataacatgctttatactgttcaagacaaatttgtaaaaataaatcacttctcatttttttgatattaatcatggcatagtttcttttttaaatcttaggtgatggaaaaataaatcatgtgctgtgaataccctttgaaccacaagcattgcaaattgacattacagcatagatttttcatcttgacagcttatcgtaggagccaaatagccccagattttcattaaagaagaaccaaataaatctggtcgaacataaataaaacaaaatatttgtttatcactgtaaagaaatcaacttgtagattgaattccatataatatttatgtcaactgctacttgatagattaaaattagcagtaattttgttgttttgaaagggccagagaaaagggaatttattaaattaagaaactgcacctcaatttgttttaagggtaggaaataaaaagtaaacacaggaataaagtcatatcatctttttcaaggcacagaagaaaaaacatgtacaaacatgctacagagtatttgattaacaggaaatgcttctgccaatacaaatctcaatgctataagctgttgttttgtcagcgtacttgtaggataaaaggaatcagcttgaacgtattctaaaatacccagaaatagtgtctctgtgcaaatatgtgatatattgacataaaaagatcagatgagcaattttttttctaccataaattcatacaaagagccagaaaaagagtcaaggatctcctgctattgcagaatatttcattaaaggtaaatttccagtaaaatactgctgtgtttttggagtagaaattaggttctgcacatgacgtgggttaaagaggatatctaagtaaatataagacaatttaacgcagaatctaaattaaggattatgatcctcctcttccttttaaaaaatatttttattataaccgctattaacaactattgttatataatagatgttgtgcttattcttcagatgtgttcactttatttaatcctccacagcacttctatgaagcagctatcattaatgccactctagaaatgaaaaaactggtcacagagagacagtaatttgcttttggtcaactagttagtgagtgtcaaaggcagaagtgaagtaagattatctgattccagtggctgttcttttgattcctgtgtagatgtcaaaataacccatttgtatagaactttgagagttcttaaagaaattttaagcctcttatctaatttttcacttgtaactattatattcagtctgtggggtggtagctgttctgtataatagagacactaaaaatatatctggtttttagtagtagttctaggagtgattaacttcagagcttatgatattatcaactgaagattctattgcaattgcatctcccttgccttctgcccaatccagcttctcttacttctttcacagtggttttctctaagaataatacccaaataaatttcttgtatgttaatccatatttaagagtctatttccagggacactgacctaaaatagtaatttttcaaaatcaagccattctcttgagtcttttgttgaatcatcttagtctctttaaaattcttttgcccttttcttattttttttcagtaccttcgtttattgttgtaacctatgaagtatatttgttttttagttatgttattctgttcccatattaggaggctccagcttgtggcactttgtttccttaggtgttttgtgatttttctttagtataaatttatatttctaaatttttatttgtgataattgcttgtagtgactgaagacaagttcttctgggaaaaaaaatgcaattgtttctgctacggattgggggctataccaacctagatgcactttaaactgtagtattgcattaaggttttcgcatcacacaatttgaggaaattcaggctgcaatccaacataaaggctgttttttagctagaagcattacttttttcccccttcattcagcactagaagtcaagataggtatagctccttataaaaccctgaatgagtggacatttattcctgttttatgcttaaaggaggggctaggccatttgctgggcctaggtttatgcagggattatgctttcgattttctattttcagccaccactggacattttctctctataccttgtgctttgaaaatatatgaaaacaaaaactcaagtttactagaatgtgcaatggctttcaaggtggaaaccagtatcagcattctgcttgtcactttcattttatcctttcatttacttatgccttggatactctttactttctatttagttcatcaatgcatttgaatgttttaatacaacagtaccaatctttttggcactagggactggtttcgtggaaaacaattttttcacagaccggggtgggggcatacggtttcaggatgtttcaagtgcattacatttattgcacactttatttctattattattacattgtaatacataatgaaataattatgtaactcaccataatgtagaatcagtgggagccctgagctttttttcctgcaaatagatagtcccatctgggggtgatggaagacagtgacagatcatcaggcattagattctcataaggcgtgtgcaacctatatcccttgcatgtgcagttcactagagttcggactcctgtgagactctaatgccaagacagatctgacaggaggtggagctcaggtggtaatgcattgatggggagcagctgtaaatacagataagcttctcttgctctctggccactcaggtcctgttgtgtggcctggttcctaacaggccatggaccagtattgatctgtggcccagggtttggagacccctgttttaacatattcagcatttatgttttgtttgttttctccagcaaaaaaaaaaaaaaaaaaggatgagcagattaaccattcagccatactgcagaaaggtgtttctcccagtaacagtcatcaaattgcttcatttttaacatgtggtccttttcccccagcccagccagctgtaattaagtgaaagtacagagcagagatgtgaactctttttcattttaataaaagctatattactgacataatagacgaagatttggaagaatgaaaaattaaatcagtcttccctctcattataactaaaggataattactctatccagtataaagaaaggttgaaaaatgcattagagagaaatacttaaaaactgatgggatctaagaagactcttttcattgtattttctgctatcattgagaagtacatgagattttgacagaacccacagaacagtttggaattctaaaaataccacattttcccttaattatttctggaacagtgtaaagaattatgcttttagaattccctaataacccaatgaaaagggttaagatgtatttttgttgcttaagaaggggaaggcacaaggcagccatagcaagtatcctatgatccccgagtaacaagaagagcaaaacaaacaaacaaacaaacaaacaaacacaaagtttggctgagagaaagcaagcagatgttgaaagggtctgtgattgtgataagaagacattataacaaagagtagtgtaaaatgtatgtcaagaaaccaggtggaaatacagaaacctcaacagatgccaatgtggtgggtatgtgagacatgattgtacatcacaatagatgtcagtataggacaatggaaggctgattcccagatgcctcaccatctaatataattgtactgtatgaactttccagaagttaaaccaatccaaaaagcaaggaagaagggggggagacaattttgatttaactgaattaaaacccaaaatgcctgagaatcctttaaaacctctgaacttacttggaattgattcagttaagtttttctgcctctaagcaaaatgggaatgtaattagaagacaattctgtttatgaaaaaaataatgaaattaaaataaagcgaattacatattgtgttcacttgaattttacaaaatatgtatccactacatgtggagatcaagaggctagtctctcaagaaaaatgtcgtggtcaattctgtaaaatactgccgacagctaaggtaggatgggaatatgtaggatctggcaacaagttattaattggtgacatagaatcagaactctagtgtggcaaaattaaatgaaagttgagaaagtttaagttgcctttataaaagagaaaataaaaactgttgttaaaagctagttatgaagggagattgaaataaaaagacaaattaaaaataattgctaacaagagatattaggtcgagacaaagcatgccatgttttatttaagattagggatatgaggtcatgtttgatcagaaggagactgtgacagaaattaagatgttgaagactcaggaacaaaaacagctaaaaacagtgggagtagaggggaatgcatgtgcaggggctgaacttgaatcggagcagcgtgtccttcattctaatggaaaggggcatagtatgagctgaatatttgtgccctcctctcaaaattcatatatacaaatcctcagccccaatgtaatggcagtaggaggtagagcctttgataagtgattatgtcttcaggtggtgcccactagaataagattaataacccccatagaaagagacccaagagagcttgcttcttctctctctgccctgtagcacatgaggatacaaaagaagaccaccgtctacaaatcaggaggagtgccctcaccgcaaaccagatctgtcagagccttgatcttggatgttccagccactggaattgtgagaaataaatgattgttgttgaagtcaccaaatatgtagtattctattatacagtagcctgaactgatgggacagagaggcagcaggtcagttcttacatatggtagcaaaaagattatgtagttaccatctgctgtatttgttctggtaagaagtgaaataatatactgagattaagagagggaggaaaggagtaggaaaacatttaaatagtgtgtataagatgttatttaattgcggaacttggccgagtaaacttgctgaagaaacatgattttttgtgtgttttgtggaaagcccacttgagtttggttctctacataaactgtagagaatccaatctacttaggatgctttgctattcagggattttgtccagagtttccatctcgcctaatgagtgcgagattagaacaagggagtcaagaatattttaaacacagtaatagtaagtattatgcaaaaatgaagagaagctgggtgtgaagagtgtgaaagtattagggagatgactaatcccgagagagggtcagtgagttgggcccctccttgtagaaatcatttgtgatgatggtagctgttaaggtgatgatttcagttgatgaaatcatcaatgatttgaaagaagtaactggaaaatttgtaaacactccacatcagaaaggaaagggggaggtagacacggaagccaggcagttcaaatctgatggttaaagcttagcagaaataattgcctggaagcagcacaaggaagcaagggagaatcataatcgtgaagaatctgtgatggatagatttctatttcattttggggtcaatggaagtatttgtgaacatggaaaaatgtgtcatttctttgaatgggctgccttctaagaaggcagtcacaggaaatactcaaataaagactaaatattagttatactgtgaagaagttattttgtatcttcagatacaaaagattagatcatataatctttgaaatctcatcctactccaacatctcttctgaaactgactgttcatcctcccaccacctacatgtttttctcttaagttcagttattagcaaaatcgactatatccttaatctcttccttgaatgtctgtcacactgacttgctctaacttaaacctggctattttccaatgataacctttcttctgcatactttatatgtttttacccaaagtgggtaagtgtatttttgtattaaccaccctgaagagatattcatacaactgtctttaccttttctataaaaagcctctctctgttgctgtcatcaaaagtccccttcctttgttctttgataatcttagttctttactcattgtaattctctccaaaactacttctgtggtaattaattcacagttgaagacctagcttctccattcttcttctcaatcatcttggtccccattttaactccaaaactaacttctgtgattgtatccatgactttacagtaagccacactgttggcttactaacaattactattatcctaacacctcaatttcaaatatgtcttataattttctattttttcagctcaatccctcttagaacccagctccaagaatcttttgaagccactgaaaccttaccacttttctttatgtctccttcctcacccaacattcatacttcccttattatccggcttaaattttattgctaatcactataaaatcacttccttaaatgcaacattgtttcctatcttatttgtatagtatattaactaaatcaccccaacaatgattgaaaacagttctccacatactattcatctgcacctccaccagtgaacgagcctggagggaaaaccaaacacccaggactgactctcctttaagatcatgagcactaactcacattgtatcatcctaattcattcacttttttactgtacctatatagaagtcttctgtactatgtcctcttgcctcaaaattatccactgtctgctgtgaccactttttctacttcacagaagaaagaaaatcatttaaaagacaaattacaaaaactgtctcttcacatccattttcccacatttatacttgaatattctaatttattttattagcatggactggaccctaagtaaatacagtccttctattgtgtacataaccttatccctttccttctcgtgggcattgctctagtaattttcccatctctctcttgaaccatcaaattttcccatcaactggatcatatccatcaacatcaagctaacttgcaattctataaaaaaaaaaaaaaaacctgccaattttataaagacaaattatcttggcccactttctcttccagctattatctcatttctcttctatcaataaagtaaaactcattgaaatggctgcttcgcttgattccttaaatatttttctacctattttcttttgggtcaactatcatcaaatttttatccccacagctccagcataactgctcattttgttgttaaaattagtttctacagtgctaagtccaatggtcaattttcagtactcaccttttttggcctatcagaagcaattggcaccattgatgagtctagccaactaaaatactttttttttttttttttttaacttggcctctttcctaataacacacgggcctggttttccttctattttgctgactacttttcctcagtctacttttttcttaaataatctagaaaacctctaaattttaagctacctcaagattcaatctttgaactgtatctctatattgattcccctaagtgatttcatccagtttcgaagacaaattccatgccagtaccgatgcctttcaaatttatgtctccagctcctaatactttctgaactccaaacttacttgtacaactacataagctagttatataaaatttaataagtcaagaacagagaccttcacatccacccctaaaatttcctgttttgtcttcaccaacacagtcaataacaattctttccttccagtttcccagttaaaaaaaaaacagacttcctttagtcttttatttttctctcacatacacaacttgagtaaatactactggcatttctttcaaaatatatctcagcaattcttgcttgcacactagtccaagtctcttacctaaattttagaataaacttctacctatttctctgctttttcttttactttttagtctattttaaaaagaagccagagtgaccctggttaaacttaggacagatcacaataccacactactgaaaaggctttaattgatcactgttttccttttcaaagtgaatgctagggcattctatttgttctgtaaacttacttataatctgactttcttctcctcatggacctcatctaccacaacatttgtactcagtcattgcctactccgcctttataatttcaaaactgcattaaggtcacacaccacctgaaggtctttgatctggttgttccctttttctggattctcttctcacacatatttgttttccttcatatcttaattttttaaataatgtttttagtgaggtattccagccaaactaccccaattaaaattgttattttaattcttagacttaacatgtccttaactttttaaaaaattgtatcacttgctactattcaatatatggatactttatatagttccttggttaatttgttttccttctagaataaatatcttcatacaggtgaggatttttgactgctttgttcaataatggatccacaaagctgatacacagagcaggtactcaattaatatttgttaaatgaatcatgccattcattcaattttatagtcagttgcaagtatgaaattcagtttacattcatccaactcatacgaggagtgcgttacatattgttcgattttattactgcttttggaagtcagcctctgtatcaatacaatttcaggactgattattaatagaaaatgttaagaatatgacacatatgtctatgcatttcaattgtaaaaataaattaagtccaagactgggcttattaattaggactttggggttgaatttccaaccttgccacaaaattagctggtcctgtgaatctctaaaactgaagaggttgaacacaaaagcccgtttatatttttttatggtgtccatgctattactgggaaaaagctcttttatcataaaattttattaaatacctattcatagctatagcagaaagggacaaaaggaagatttttggtgtagtaagcattgaataaatgccattaaatgattgtcgttagggtatccacttttatttattattgtcattccaatttttgtcttattactctccttaagatgggtaaagcagatttttaattcagctatgtttccctgtgcaaaaaaaaaaaaaaaaaaaaaaaaaaaaaatctatgttataattgagacaaaagctttttggaaagcaaacaaataagctacaaatgatataaacttaagtcaaagcaaacatttttcaatgtttgtagtacctgtcctaaagatatgctgttatatttacaagtctatattttattcataaagagtaaatttccaaattcaaatacatgtttattcaactttaaaatttatatattcagatataaatcatttttagtcatttactcttttaataacatccaaactaaataaagcatatattctcacttaggaagaatatgtatatacagttagccctccatatacatgggttctacaatcgtaggttcagcaactgcagatgtaaaatatttgggggaaaaaaaaaggatggttgcatttgtactgaacatgcacagacttttcttatcattattctctaaacaatacagaataataacaatttacatagcatttacattgaattagatattataagtaatctagagattatttatactataaatgaggatatgcacaggttatatgcaaatactacactattttatataaggaacttgagcatctatggattttgttatctgcctggtggtcctggaacaaatcccccttggatactgaggaacaattatttttgtgtgtgtgcgtgtgtgtgtatatatatttatttatgtatgcacacaaacacacacacacacacatatatatacacacacacataagtcctaaggcatattatatatatatatgtttctgtaaattgagagtctatttataatataatattccttatgagctattcatagctaaaaagcttctccaaggatgctgagtactccatttttatccccaagtccataactgttgctgattcacaatcattatttttgaaattacaaagatacttgaagcaaaatgttcattttcattttagcaagaacccttcattatttcaatccttttccaaattctttgcagacaatgttgaaagctatgttctctttttatgaagacaatagaattaattttgtttcagattattatgagaaatgtggagttttagaatctttttttctttgaaaaaatactacttttgtgatggttcaaaagttgtaaaaataatcatggtcataaggataggattcattatatttttataatgctttttgctttcttttgtagattttgttcagtagaaaattttaaagccaaattgaagaagtttgtagaagtgtgtttataacactgaaataaaattgaaagactaaatgtaagcttttattaaccaaaaagataatagagggtgcatttaattagaatattaaattagaacaaataaaaatatatttttgaaatttaatgccacttctgattttgtagtttttatgcataaaaccatttctgcacagtacatcttttagagttgtttgtacagtagaatgtcaatgtatgttttagtaacacttctataataggtttctcagaattcacaggatttcagaaaagcctcaaagtcctcatggccttcaatagagcaattcttgtaaaataaatatcggtctggtcttattcttaatgacattaagtcaaaacaagtaatttagatacaaatgctagggatttgttatttgaatgcacacagttctttagtaaaaattattgcatccactttttaaaaagtaatttcaacttttatatacagagagtacatttgcaggtttgttacatgggtatatgatgtgatattgaggtttggaatacaaattccgtcacccaggtagtgagcataatatctaataagtagtttttgaacccacacccacctctctccctcccttatctagtagtccacattgtctattgttctcatcattatgttcatgtgtactcaatgtttagctcccgcttgtaagtgagaacatgcagtacttggttttctgttcctggtttattcacttaggattatgttctccatacccaaaagaaaataaattgttttaccaaaaagacacatgcactcgtatgttcatcacagtactgttgacaatagcaaagacctaagggcccatcattggtggatgggataaaaacaatttaaaataaagacatttaaaatggttttagattatactttaaattatttggttttattttcagttgttccaagttatcaaacgtagaaattgctgtataatatttttatatgatcctcttttgaaactataatgcatattattgttaaaataacacactgaatgtagtaatttcctcactttttgcataacagtaactaaacaaaaaagtggcttagaaatattaatttaaaaattggaaaaccaacgtgttttgtttggtggcattttagttatctgaagtgtaagtaatgcttgaaaattgttttatataattgtcaagaagcaaaataaaatttacttttaactcagaatacaaaatgactacgcagaatcagtctctgacactactcatagaaagcacccccaaagatttcagaaatttcatgcaagaatagttttgcttgtgcacaatgattcatcttcctcttattcctacccaactgcctgagattttcatgtcatctaaggactcttctaatcctgagatggtacttttgaataggatctccctttagaatactaaatataataaagaactatcatgaacagtagaatttatttaactcctccatagttttagactacatatttaaaagtaaacaagcaaaacagtttacaaaattgttttctgtattgtatttaaacaacattattttcacatatttgattatgtacctttaacttgtaaggcttatttgtttatttagacattgaaaattaataaggtggagttagtctatggttctttgtagttaatttatatatttattcttatttctatggtttcttgggtcaccttctgggtttagggttatcagagattcatatttcatatattatttacctcacactgtacactccctgatacaagtttctgaagaaaagcatagtgaatatttgctgattaactaaaaccaactgagaataaatatatctttgcactccctatttggaatattttgttgtttgtaaaaattcttcctttttctcaagtgcttgctgcatgttcagtatttgtagagtatacttccttaattgattaatattaagcatggctctttaacttgctttaaccattaaagaaggggcaggtgaaacttcagagttaataaaaagttgcatttatctgtttctgcttaatagtgccttaaaagatgttgcatttatgtgtttctgcttccaccttgctccatgagtatgacatgcctcagtttgccatttttgctgtagtcagattcccagaatgaatacacatgaaccaaaccctgtgatccggtttagtctgtttagcctaaatgagattagtggacctgaagactactgagattaaatgaataattattgagccattgagtttctggaggtttgttatgcagcattatcctggtagaaaaatggcaaacactccttagcatagtaaattagtatatattcagagcctcttaatataattgtaaataaatatgaaaagataggaaccatcttggcatgtaatcaataataaaaaaataatactaacatatcttaaatcttccatcttgattaaatagtgttcacagttgatttgttattcccaaactaaagctattacactgtacatacatttgcataatatttcaaagagcaaaatatgtaacactttcattattccaagaaaaatgtgtttatgtatatatgtgtgtgtgtatgtgtgtatgtgtatgtgtgtatgcatgtgtgtatgtgtatgtgtgttttgcatgtgtgtatgtgtatgtgtgtatgcatgtgtgtatgtgtgtatgtgtgtgtatgtatgtgtgtatgcatgtgtgtgtgtgtgtgtgtgtgtgtgtgtgtatagaagtgtcatttcggggtcagtctcaggttactctctggcttccattcagacacaataagtacggcagagttaatataagcatttcttcacaaagaactagggaaatggccatactgtgtaactttaaaacttttttaacattagagatagattatatacaaagaaaatatattctcaattatatattgttgaaaattgcaatgcatacttcagtgatttaataacttatggtacatatacattttatattttaaaagataatgtatcccaggggaaaaccagctttctcctgaagagattattttacacttgatgtaaatgtttagaaagtattggcacaaaataagacattacagctttcacataagttttctggctatgatagatttctgggtccctaaagtttctgctttgctaattagccggatagtatgaaataaagactcacagggatgaaagcacagaggaaataatgaatacatttccttaattttacagattgttaaacaaagcccaggtttttccaggttcataaattttattaaactgcaaatcaatgtccatcccagatacctctttggtcttccatctctataggattactacttagacagctgactcctgaaatactagtcaggcatttgaaatttgacagctgtaaaattaaatttacttttatttttcacagttaagtgtggctttttttcttactcaattaaattgttattaagtattaagtagtatgaacgttggtatcagcaggaaaaagtggcacactcaaaatgtagtgatttaggagactttaatgcaagggcagtttcaaagtataaggacaagttcaaagaaaccaacaaggcatatggaagcaccctgagctgagcaacagcaggagatatgaatattacttggcttgaggcagtgggaaggaacatgtactgaaatttacagcgggctgaagctggtgctgtagctgcaactacaagagagtactgctccacaagagctgtaaaatttggtagagaaactcagcaagggctaatttatggccagttagggagacaaccacggaactaaataactcaacttctttctactctaccatattctctcctgaggatagcttccattacccagactcaataggttgctaaggaaaaaaaaaatatgattgacaaagacagtaaaggtttgttttctggtgccaaagcagggtggggaagaataaacgggaaacctagaatggtaaacagagtgtatgtagcacacttgtacagtgtttcaagaaagaaacagaagaatctttcaaaatctctcctccttcactccatccaagttcatagtacattttggttcatctaaaactccagtggaactctgcctctccgtggattggtttaatggattgaagcaaccactggtgataaatgccagctctcagcacttctcataatgaggtaaaaaaaaaatcacaagtgatttagattctccattattcattattcactatttcaaggtgctttattatgaaatccaggacattcttagcataacaaatccagagttaggagtctatgagtatggatgtgggtgtgtctttgtagaacacactctgagattctgtgtggtaaaagctctccttcaagtgtgtcacttaaaaaatagctgcaccacatctgagggccctccaccacagtatgaacaattttatgacaaggatccaaacccgacaattaaaaaaattgaaacataataagcttaaaatgtgtattggttctggggaagaggctgaagtgacttgtggaagaagaaccatgatgcaaatccgttctgcatgcatcagcctgcaatttccttaagcactcctggacagagaagagaatgtgcctgcaggtaatgactgagctggagaaatagtaaggctgttcacccaaccttctcttccctagagggtagttagagctacaccctatggggcagagaggaaagggtgtaccacctgtgttacacctgtgcaaaataaagttttttttttaaaaaatgggctcttcaccatctactgaaagacatttcatcttttaaaatgatatggaaggtctggaataactgaatgataccaagaaaggcatatatatttagattcaaaatggtcatgtaaatgaaggagttcgcatctggagaatgaacaaatttctgtgtaatcaaagtattttttactttgaagaactaaagacacatttggtataaaggaagtaccaatttcagaagatatgcacatacttcttgaatataatgttgactttgcatttctacttcttattctggagtccaactttacaatatagcatgcatgggtttttacagtgtggttaagtttcaaaggaagttaaacagcaagataatagtaacccttggaaatagaggggaaaatatatgaatgccagaaacattggcctagaaaaccaaatttttagcatgatttgtatctgttgaatgcttaactcaatgcccataataatcatgttttgattaatggtgcatgaatgaatgaatgagtaaatctggctccattaaagtatcttctttttaataaaactacaaaaatttaaactgagagtccctgtctctggtaatgaatttgtgtcagaatcaagatatggaatgactgaatacccccacatgaatcaataaagatttctttcagctgtagaaatagaaattcagcttcaggaacttaagccaaacaaagatttcaggcatttgttttaatgaggcagaattatacagctgtctatctctaaaaaagggaacatcaccattctctgaagtggtgtttgctccagcctcagtgaggactattactggagtttgttcttctagaacatttcatcccctctcattcactctgctcacagaaagctggcatccacatttcccagtgagtagtcaatgcagtgaaattctcttagtgctggctaaatctctcttgctctcttagactttcctattcaaggcagagcaaacacttgtggtattgtctgtctattttcatttcttctaacccattctccacaaggcagctagaaggatccttttaaagcagaaattttgttgtgttaaacctctgtttaaaaacctttaggggcccaggggccttaaaaccctttaaatgcctctgaagacagttcaaatgtactgatttatcctccaaagcttttggtgatctgttatttatgttgctcaggagaccacaagtataatttaagggtgggaaaattacccactgtactggactacccttgtaatgaaatcctcacactcactaaatcttggtaataccacttctctgtcattctgacatacaaaaacatctccagagacccccaaatgttcctgagaaggctggagaacctgttcagttaggactattattcactgaaatactaaacttcaaatacagtgaattattcacagttcacttaacaaacaacaataatcattttctcttacaataatcattttctcttacctctgatccttctacatgctcctcgctcttctcttctggaacagtccttcacctccatagacctgactaattacaggaagatcaacaaatatcaccttaggtatcttttctgagccccctccaaatataggtaatgtctccttctgagttgccgtagagacaccttatacttaccctggatgtgataatttaacaaaatagtaggatctaattacttgtttgtttcgcttgctacatttaaagccatttgaaagcaaaaatattgtcctattcagaattgcgttcttggtttccatcctctgatgtacttaccaggtaatgactcatactaggtgcttaaatataaatgaagtgatgagggtggcactaaacttggaacctgatgaactgagtttgaatctgtacttcaatactatttgtgtaatcttggacaaatctctgataaactcagagcatcctccagtgctccttatcctgcaggatttcagtgaggattaaatgagttaatgtatgtaaaatctctttaaacactgatttatacttaaaatcattttcaattcaaactataattttctaaatgttagtagaaatgccgttgagccgtaagttgcattttcctaaatggcttacaaactttctggactgtgcagcttgttagagaatttaaatggctgtccaactaggcgtgtatttcaaaacaattactcaattcaactatttaatcagcctgtacttgtgtggaggttgttataattcatattaaactagctactcacgaataatttcacaattatttctctttaaaattgtattttttctaagtcctctaaaattttgtcctaaattggatgaaacatagctaaattatgaaaaatacaatagcatatggacagctatgtgttaacaaaggttttagggcaatgatctttttctttttcagagcaaatttcactatagttttctcttagttaatataattgataacagttatagagctacttggcattctaaacatgcagacatgtctttcgctgtctaaagtaaaattaaaaactgccaatagtcttttatgttcagtggtagctggaaggaaatttttttttttaaaaaaaagctggtaataactggctgatacgtgcaatttgaaagacgatagacctgagttgtgcgtatgaggaaggaatgacccaaagtactgtgacaaatgcagaagagaaactatccacacaatgaatgtgggatgctaaagtctttaacagttagctctgtagcacataagttacccatcacaattaatgtcaagaaagctaatttgattagcatcaatactaaatttataagcaattaggaaccaagccctgtttaactcactgcattattatttatcaatttatcagtggatatctgattagagagatgtaaatacctgcaaaattcctttgaccaagccatgtgtagctcaaagaaaaggtgctaagctttgacctattaataggctaaagagtcatactaagtagttgactactaaggcacactaatctagtcattaggacagtgtcatcaactcattttcatataatattggcaatgagaactgtaacaaacagttctaattgtataattaccttaaaatctgcctctggcctctgaataatatcaagaatttatgattatagaaactggaagcctggcgaagagccagaaattaaacattttatttccaagtctactcctcaatgaaagttgaatctctaagaattttggctcatgtacctaacatgcaaacctattcaaggataattgactttaacatttaggaaatacgtgataaaaatactacatgaggtcaagagccatgtataagaagaggagggggagccccaagaacagaactggaggccatgctgaattttggaaatcagagtaggagaatgagtagtcagggtcagaaatacagagtgtgtaatatcatgtaaagcaaagaaacatatcagagggagatggtaatcaataattgagtatccatagagactttaactgtataagatgtgaatttgactatcttgctagagttggattttttttaaacatttacaaagccatatcttaagaaaattatcaagaaataaagaaaatttaaaaaatttagtatattagtaggtaattcagccaaagaagctagtaggtgttcacaatagttattaatatttaaaagtgttgagtgcttaattttaaatttaagctgaaaggaatatattttcttttaaccttttttttttttcaattacatccaagcttatttaaaaagtagctgacacattgttttctttttgtctacccactcattctggtactcaccccatctggtttacatatcgtaaacctgcctaaactactcttatttcagcaattatcttctagtcagcaaaaatagctgcaaacaaacatgtttaaagtaatgttaagagtaatcagacataattgaatcgtggtttttctcagtagttaaatatttatttgctaactttccattcttctaaacaatagatgcactttaaatattttattcaatatttagtatcttatagaaataaattaagacaatatgcaacctcttgagtacttcaacagatgaccagtcttgtgtcttgttaattgtattatattgcattaatttgcataaaatacatagaaacttttgcatctgtaagatgtctaatgtaaaccctataccttcattcaattgttttatgaggaaatagtatgtcattgatcttactttgatatgatttttccttttaaaagacagttcattgccctcaaaatattataaattaggtaacagaaagaaaaccaaacaatgtatcagattttaaaattttctcttaatttttaaaaatgtcaattttacaactttcctccccctactaaataattaaagacaaatctggcttttatgttaaacaacttaattctaagtagatggaaaacattgcatcagatggcaaagaatgctgccaattttggagattgtgcagtgtgaaaataaaaacttatgactatcactgcataaattttaatgacttctacctttttgagggaaggcttttcttcagtaaatagagtcccatttagctagggcacatattctaactgatgtcagtagccaagttacatgtatgttaataggcactgagaatatagatttgcctgggttgaatggtgaggattaaggtttattcagtttgattataggagcaactttggtcaccttgaatctctgaaagaatatctcgcatatggtttgagcatagtaggaatcaatgtatttgttggattgttgattttatctccctagttcccatatgactgaactgaaatgaggtatatcttgtcaaaatttagacaaatgggaagattcttgagaagagtctattaagagagagaagaaataatttggtttaagtaagcctctggtaactttattcaaatgtggccaatcctttcataagaactaaagtggagtatcataggcaggaacatatgtgcaaggaaggttatagctcagctgaaaaagctaaaactaccaatcactcttatcagaaaagtccctacatagatgaggctgaattcagcctgaagacatgttcttgtttgtactgtatggtgtcttaaaagtgaacttgaatatcattagtcacgggctatactttctacccactattcccaatcattttaaactagatctgctttaccttcattattttttgactcacctccaaggcatttgagtgtgagatgcttgcctagacaaacaaacaaacaaaaacacaacaaaacaaacttgtccatggtagtctttcagttttgcccagaaaaagatcccagataacaattcaaacgaaaatattacatttgggaagatattatagtaaaatctactaagggaataagaaagaaatacaagagaaaaagagctgatgcaagttgtgttgttatgctagttactaatataggtaacttgacctcaattctctggggagctttgcaagtcgatatagaacaaggacatcctaacctagggataaaagaggtagtatatattttattttaccaactctagtcaacaattgttgaaggctaatagggcagaattgggaggcattaattttcagaaacttcaggccagacatgtaggctagactttaacagttagaaatgcacctgaagggtaaactttaaggagtatggcctggtcagccagcatctacgagagcttgtgtttgtttaaagtgctgtgagagggttgtaagttacctcaatagctcataccgtaagagccttgcacatcataaaccaaggggatgagaacacagtaaggagatcttacagattaagaacttagaacaccagtgccaggagaggaaccaatggagggaatgggttcatcactggtttgaaaaatagttccaacaaaatccactggtatgcaaaatgtcagggtagacaatctactagagaatattcactgaggaacattctagaaacttaggttactgcagtgtttcagttataacacactaaagcaatccaaaaaaatatagagccatgtggtcgtagaaattttcttgtactctacattttttcttgatttcttatgtctatcaacttgtgagaatactgctgtacttttaacgaacattaaccaggtaagtgtgcagatgtaaaaatccaatatcctatgaagatgtaaaattagaacaaaatcaaagaagattaagaacaagtaaaaactattgaaattttagcttttccttcccactccctgaatccagcccctgcactcagctaagtaatggacatctcaagacagactagctttgaatttaaagtgacttatatttatatcctgagtttcttatttctaccactctaattaatagctttagcataactgctattttccatgaacttctttatagaaatacaaattacagatggtggtttcttagaaaattcaaagcacattgcttaatttattgatgatttgtagtaaattacaccatgtcaataagcaaattaaagccttaagaaaggcaaaatatcaacacaagcctatcctccttcagcttttgttatgtaaattgctataaaatgtgataatactattataataaggaaatagaagagtatattgcaaaattaggcttataaaatctcaaaagttttgttaggaccaggcttaattcagcatttaactgatataaaccatatattcaataacatgttttaagatatgaagaataaatgctatttatattattttcatatgtcttggagcacaatgagacacagagacttataaaagcatatcaaatataataatgatgtatcaccagattgaatgagataattaaattgtaatgctcgccaagtaaaagcttctatgtattttatatagaaaagttattttgtgctctaaagagatatttctggcctgttggacttataatttgtctctgtgagataaagcttatattgttgagttaattaaatcctgtgtctagtgttcaatcattcagttagtgacatttagtctcatgaatgttccacagtttattagattaggaattttaaacacaaaatttcataaaaagtgaatacatacacaaataccacactctcttgattattccagttttaaaatgacttaaaatcagataacactaatcgtctagtgttatctagaatagtcaaagcaagcaagttgccactaataactgccttggctattttaggtcttttagattttcataatagttctagaattagcttgtcaatttccataaaattcctttgtgagaactgtgattggaacacatgaatgaatttatagattcatttagtgaatatcaatatcttaacaatatttaatcttccaacacatgaacataggatatctctcaatttatttagcttttccttaatttctttcagcattcaagatagccaaattgttaagatagaatgaccattaaagataacagaatagaaagtccagaagtagacccatgcatatctagacaacagatttttgacaaaggtatgaaggcacttcattgaacaaatataccctttttaaaatatcttgctggaacaattgcctatccatatgcaaaaagtaaaacttcatttcatacttctcaccatacacaaaaatttatttcaaatggatcatagacctaaatgtcaaacctgaaacaataaaacttctagaggaaacatgggaaagaacttctataaccttgagttagacaaagatttcagaaatacgttaccaaaagcatgatttacaaagaccaaatctataaactagacttctttaatgttaaaattcgtgacctataaaaaacaatgttgagagactgaaaagccccccaaagtctggccataaactggccccaaaactggccataaataaaatctctccagcaaggtaacatgtccataatggccataacgcccaagctggaaggttgtgggtttacaggaatgagggcaaggaacacccggcctgcccagggtggaaaaccgcttaaaggcattcttaagctacaaagaaaagcctgagcaatctctgtcttaagggtgtgttcttgctgcaattaatttggctcatcccttcatttcccttaagggatacttttagttaatttaatatctatagaaacaatgctaatgactgctttgctgttaataaatatgtgggtaaatctctgtttggggctgtcagctctgaaggctgtaagacccctgatttcccacttcacacctctgtatttctgtgtgtgtgtctttaattcctctagcaccactgggttagggtcaccagcccgagatggtctcggcagtcacgcaatgggagactatttcaaagcatacatctgaaaaaggacttgtaaaatatatacatataaaggactttcaaacttcaatattaaaaaaaacctcaatttaaaaggtaggcaaatggtttgaacactttacaaaaagatatgaatagaaaataggtggatgaaaagatgcttgatatcatcagtcattaagaaaatgcaaattaaaccacagagagaaagtactataaatttagactgcctaagatttaaaaagattgaccatactaagtgttgaaaagaatgtgaagcaactggaccactcatatactgttggtgtggatgtaaaaatcacacaactttggagaataatttgacagttttaaaaaaatgtaaacaaataagtactactcctaaatatttacctgagggcactgaaagcatatttatatagagagacttgtatgtaagcattcgtagtagctctacttataatagccctgaaccaaaacaaccaaaatatccattagcagatgaaagaatacataatttgtgatatttccatgcaatggaatttgactcctcagtaaaatataatggatccttgttatatgcaatagcataaacaaatctcaaaataattgtattgaataaaagaagacagatcaaaagagaatgtacttgataatgtcatataaaaattctacaaaaggcaaactgatctttagacaaacagcagctaagtggttgctagcaagcaggagtgaagggagggaaggattgcataggggcattacaaatggggtgagatgcatattcattatcttgattgtgatgttagttttatgggtgtatacatatggcaaaactaatcaaattgtagactttaaatatgtgtagcaatattatagttcaattatatctcaataaagctgtttaaaagatgaatgcacacaatcagaatggcaattttgtaaagggacatgaaaaataaaactgccacatggattgcagcctgagaagagatatttttccctgaaaatagtctatttaggaaaccaaataactatatttattgtagagtaagaagttagaacaagaaaagatagacaaattgactgtataatggaattaggctatatattcccaatatatccatctctgttttaggacagacttccacagataattaaaaattagtgatgttttgatcaaactttctgtcccctggacagagctgagaagagttttgtcaatattttcctctgttactcaccttctttgcttccatgatggtctgaaacataatggtcattttttttcctttacctatgttaacgtattcaatcagactttagtttttaattcatggtgagtctctcaaataatttcttcacaacacaatgatgactagttatatatatatatatcaacctgggttaggctatagtagtcaataatgtaataaaatactaatctgtatgttgctgtgaaggcattgtgcagatgtggctaaaacctacaatcagttgactttaacatggttttagtagagcagattactttcaataatgtggatggcctcatgcaatcactgaaagcctgaagagtaaatatgggttttctagacaaataattttgcctcaaatctataacatcattcctgcatgagttttctgctgaatggcttgcctcacaaattttggagttgttagccccacaaccatatgagccacctccttacaataaatattgtaatatgtctatatctacatcaacatttctatacatctgtattacactgattatggttttctggagaattctgactgataacattagtaatataatatgcactgatttcatagatttactatgcagaggaatatctttcctgatttcctgaactgtggcactctaattttctcaccccagtgctaataagatcttaattaacacatagtgaattattttttcttttcttttctctttttctttctttctttttttttcttttctttctctctttctctctctctctttctttctctctctccttccttccttccttctttcctaccttcctttcttttcttttcagggtctcactctggttacccaggctggagtgcaatagtgccatcactggtcactacagcctcaacctccccagctcaggtgactctccagccacagcctctgagtagctgggactaagtgcatgtgccaccatgccctgctagttttttgtagtttttgtagagatggagtttcatcatgttgcccagtctagtcacaaactcctggactcaagcaattggccagctttgggctcctaaaatgttggagttacagatgtgagtcaccacaccaggtctagtaaactattttcatgattattttaagataatcataatcattaatattttaaaatatatatataatttttaaagttttttaaatgttttatttcatcttatctgaaaatacatgtattagtcagtttgggttgccataacaaaataccataggctgggcagtttaaacacagaaatttatttctcacagttccagagcccagaagtgaaagatcaaggctggccattgtttcaaagtgttcttgttgaagcttatgaatagccaccttttttctgtgtgttcaaaaggtttttccttggtgagttcatacagagagagagcaggataaagttctctggtatctcttcttataaaggaactgatcccatcatgtgagtcccgcctacacaacctcatctaaccatggttaccaaccaaaggcctctgtcttctaatatcacaacctggtgaattaggcctgcaacatacgatttttttttttgagttgggggcataattcaatccacagagatatgctcccctctaaataacactaataactgattttcctaggaattctacatttcttaaaatagtcttgcatattttgtctcatttgattttaacggccactctatcaagtataaactgaatagcatatcactatatttcataggagggaaataaactaaaactaaaaaagttaaatgacttccccagcacaactgtaataacagatacaagaactatttctttctaagttgttgcactattcttatttcgccacaccacattccctaaaaacatcttcaaatccataaaatgatgatatagctgtatggagtacagagtataaaggcaggtgcaatataaggtccttggttctggcatgtctactgactttgccctcaaaaccctgaaagataacttcctaaatctaagcagcagctaggtttccaatgggaaaaaacattactttgcttcaaatgtataacaaaatcataataagcctttctcaaatcaaattaaattacattaaaattgttgctgtttatttaaaagttataattatactatatctttaaaattctatataaattacagccataaaaaactgatgagttcaggtcctttgcagggacatggatgaagctggaaaccatcattctcagcaaactatcataagaacagaaaaccaaacactgcatgttctcactcataagtgggagtagaacaacgagaacacatggacacagggaggggaacatcacacaccggggcctgttgggggttggggggctaggggagggatgacattaggagaaagacctaatgtaggtgacaggttgatgggtgcagcaaaccatcatgccacgtgtatacctatgtaacaaaactgcacgttctgcatatgtaccccagaactgaaagtataaaacaaaaaattctatataaattactatattaaaaaatagccaaaaacttactttgtgcattgcattaaatagcctatgtttttttcacctgaagtaaagacaatactgtaaagcagagatgcgtgtgtgtaaatgctggggtctggatttgtattcacttcatccatttctccctgagatatccccatggaaagcttagtcttttcatgctaccagagtgatttgaaaatgtttgttccaggtgatacctgcatagagtttaatattttcaatatgtggatttttgttcttcttagaatagatatttatgcttaaaaatgtaaagggttgtcacaatgggactgtatgcctaccacagtagagacagctcccaacaatacagtagaaaccctagatttgtgccttcccactgactttgacctcaaggcactgaaagataaccattttgtctaacagtaagtagtaattcagtttccagttcagctaaaaccatagcctcacctcaattttaacagttgaaattcttatgtcctctctgggtcacatctggtcacttttaaaacctcttaaattcagttaccatggaaccaatggatatcacatatagtatcctgagggtgagctgaaaaagtaagtcagaaaatgcctttctctaatagcttcttttcaaaattttccaaagaacatattatattgagcacaatccatgggacactttacatttttctgatgataggtgacagctgttgattgagatcttacatcatgagcttctactgaaactcaacaaactgcatttcaattacccaaagtttctttggccttacactggtgtcacaaaaataaattgctataaaactttgcaatcatataccactaaaggttttactagaccaagttggcaggttatcacagaagcacatatttggataaagatgaatcaaaggaattttgataagctgcaaaatgttagaaaataaagctagggaacatatttttatgtccgaatcctttttttttttttttaaaaaaaagaaactaacattaattagtatttacttagcacaattcttaggtataattcttattactgcatgtttttattaactcattaagtcgttgcctaactttttgagaaagatacatgtattaactttctcttccctttatagataagaaaactaaggcacaaaacacttagtaaatttcttatattattcagataagtgccaaaatcaaaattcaaacacagtcactctggcttcataggtttctgcatgtaagtatattcatattcaaatgaatatagtgagtcatgaacaaaaaagttgaattatattaaaatttatatatggtggttattttgttatgcaaaattggtatctctaaggaacacctcacaaacttccacaaacacaaatatggagtaaaacatgctgttttgatacacggatgcattgtgtaatgatcgaattggggcaattagagtattcatcaacttgaacgtttgtcatttatttatatgagaatattaaaaacctctcttctgcctgttttgaaatatatactgcattactgttaactctactcatcctactattcagtagaacatcatggcctattcttcctacctaactgtagctttgcacttgttgacaatctctcatcatcctccctccccgctctgttccctacctctggtaaccactgttattttgcctacttctatgagaacaacttttagattctacatatgagtaagatcatgtggtatttgtctttctgtgcctagcttatttaatttaacataaatggccctcagcttcattcatgatgctgcaactgtcataatttcattatttttatggctgaatagtattccattgtgtatatataccatggtgttttttatccactcatttgtggaggaacatccaggttgtttcctatttggctgttgtgaatagtgctgcaacaaagacaggagtgcagccatctcttcaacacactgattttatttcctttggatatatatcaaattgtatgattgctggatcacactgtagttctacttttaattatctgaggaacctccttactgtttttcagaataggtgtactaatttaggttaccacaagaagtacataaagttcccttttctccacatccttactaacacttgctatcttttatttttgaatagtagctattattactggagtaaggttatatctcattttaatttgatttgcattcccctgatgattagtgatgttgagcatgttttcctatacctgttggccatgtgtatttcttcttcagagaaatgtctattcaggtattttgctcattaagaaacaggtttttttgtatgtgtgttgctgttgaattatttgacttccttatatattgaatgttaatattttatcaaatgtagagtttgcaaataaatatattctctcattgtgtaggttgcctcttttctctgttgattatttcctttgatttttaaaatgtttcagttttatggaatctcatatgtgaatatttacttttgtttgctggaattcaatggaagcacaaaagaccccaaatagccaaaacaattttgagcaaaaataacaaaactgatgttaccacatcacctatcttcaaaacatgctacaaagtcataatgatgaaaacagcatggtactggaataaaaacagatacatagactaggagtaatataaagcccacaaataaacccacacatctacagtcaatcaattttgacaaaggtaccaagcactcacagtggggaaaagacagcctcttcaaaaaacggtgctgggaaaactgtatatacacagcagaagaatgaaagtagacccttatctctcaccatatgcaaaaaaataactcagaatggattaaagacctcaatgtaagtcttaaaactatcaaatcactagaaaaaactagaagaaagctccatgacactgacttaggcacggatttttgtttttgtttttgtttttgtttttttttggataagtagcttttccaagtagcaaacaccaaatgtaaaatgagtgattcaaattcaatgagaatgcagaactgttacaggcttccacttcattcaagatggagtaaaaaatgatcttattgcctgaaacaacctaagaaaagaacaaacaaacaaaaaatgtatacacaatatgcaatgaaacagctttagggacaccgggcaagaaaggatagtgatcccagagaaataagaaacaatatggtgagttccacaatgttccagctcactgccttagtagaatgtccagggcatagaaaagaaaaggggaattcaattgaagttccaaaaatgcccttagttaaaaagactttgctgagagtactctcagctcaggggagagaactgcatctacaacaacacaaatgaatctcaaagtaattatgtggaatgaaagaagccagataaaaagtgtatgtggtgtataattccacttgtataaaactagaaaatgcaaactcatttgtactgataacatatcagtgatcacattgtggcaagatttgtaggaagagataactcaaagatacaaggtaacttttggaggtgatgggtatgttcactatcttaattttgttcagtttcacaggtgtataaatgtgccaaaacatatattgtacatttgaaatatgtatattttatagaattcaattatacctcaacaaaactaagaaattgctgatttgggcataatgttttggaaagttgagttttgtggttggcctccatggaatgatggcacttagtaaaaaaaatgaaataaaaggccagcctttctttgatgaatactctaaataccagggaagtaagctaagggttttgggaggactgtaacttgatgcctttggcttgaatattggttaatttgggtcattgtgagagtactgaggtagtttgaggctaaatattattatgggttaagtgtaattatttacaaagacattgtattttttcctattgccacaaaagtagtggaataatacaatgcaaatttattattttgtggtttccatagatctggagcccaggtatggatgtattaatttcctattaccactgtaacaaataaccacaaacttagttgcttaaaacaacacaaatctatcctcttatatttctggagatcagaagtctaaaatcagttttattaagttgagttaaagatatcaggagtcaagctggtcaggagaaggctggttcctttcggatgctctcatgggagaattaattttcttgactttttagtggtaacttctagtggccacctgtattccttggcttgtggctacttcctccatttttagagtgcatccctccaacctctgcttccatcttcatattgatggctattctcttgaactttttgcttctctttcttaaggacctttgtgatagaatctagtgccccacaaaataattcaaaataatatatcttcctaaaattcttaaaatacctctgcaaagtctctgtggcatatagaataatattcatagtttcttgggattaggacatgttatctttgtcaggggggcattatttagcctgccacaatgggttagctgagtcctctgctcagggtcttaacaggctgaaataatggtgagggataggctgcactttttttttttttcttagacagggtcttgctttgttgcccaggctggagtgcagtggcatgatcatggctcactgcagtcttaaccccctggacttaagcattcctcccacttcagcctccctagtagctgggactgcaggtataagccaccacacctgctaatttttgtattttttgtagacatggggtttcactatgtttcccaggcttgtctcatactcctgaactcaagcaatctgctagcctcagcctcccaaaactctgggattacaggagtgagccaccctgcctggccctaaggctacactcttatatggggcttagggtccttttccaaactcattcatgtagttgacagaattaagactatgcaactgaggtctcatttcttactggctgtggggtgagaaagccactgttcattgttagaagctgtcttcaggaccaggtaatatggctctctcacatagccactcaaactttcagaccaacaagggacaatttctcgcatcattatgctggtatcttaaataaccttaattctgtgtccctcagcattttcccctggttaagtaagcaatgaaaaacccattgaatattttcattacatgttttaagaaaaagcagaagccctttgaatatatttttgacatttcaaaacattttgtcctattttaaaggctctacttatcacttgttaacaaataataaacacattttgaaagtagagaaacatgtcatcataaagcagtagcaggttcaaaacagacaaataaaagagccatattgatgatgctcaatgctccattctgccattttcaaatgaaaagcaaatacaagaaactctagtctacaggtgttcaatataaatcagatatcacgttatgacacatgtttctgttctccatgggatttatgcttcttcaagacattttgttacaaaatgtaccttattgcattttctgatattttgagaaggaacaaaatctaacacaataagcatatcttagggctttgtcactggtgtagaaagaacataatgaagtacaagttcatgttcctgttttattttacttgaaatcataaagagaaattatcaagagaaaaatgttaagtgtgactcaaaacaaattgtatgtaagtgacaagcggaatggcaaaagtgtgaattatctctctggcttataaacaaaattatgaatctattctgctattcctaattcattttgcctttacaagggtatattgaaaactaggtagggtaaaacttcccccactttactcctttcaggtctgcattcatatgcagtattttttttcatgttactgcaaccgtacctaaacctatgtatactgtggaatacagtgctcatttgatatcatattaatgtgtttcactggattttaattagttttcttcatttatattatgtactcaatttataaacaactagaaagcagaaatcattttatacatctttgtatcaccaatgtccatatctatgctttgaatactatacaaaaataattcataatgattctgtagacaatttcaataaaaccaattacaatattgcacattattttgagcattttgtaatctttggattaattttttattggtatagggacaaacatacacaactgaactcaataacacacacacaaatgtgtgtgtgttgtatatggtataactgcagaattcctgacacataatagttgttctataattggtagttaaaattacacttatagatcatttcacctaggatttagctaagctctctatacctagaatacagttaagaatgacattattagagggcagccaagacggccgaataggaacagctcctgtctacagctcccagcatgagcaacgcagaagacgggtgatttctgcatttccatctgaggtaccgggttcatatcactagggagtgccagacagttggtgcggggcagtgggtgggtgcaccgtgcatgagccgaagcagggtgaggcattgcctcactccagaagcgcaaggggtcagggagttccctttcctagtcaaagaaaggggtgacagatggcacctggaaaatcaggtcattcccacccgaatactgtgcttttctgagaggcttaaaaaacggtgcaccaggagattatatcccgcacctggcttggagggtcctatgcccacggagtctcgctgattgctagcacagcagtctgagatcaaactgcaaggcggcagcgaggctgggggaggggtgcccgccattgcccaggcttgattaggtaaacaaagcagctgggaagctcgaactgggtggagcccaccacagctcaaggaggcctgccggcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctcacacggccgggtactcctctgagacaaaacttccagaggaacaatcagacagcagcattcgcagttcaggaaaatccgctgttctgcagccaccactgctgatacccaggcaaacagggtctggagtggacctctagcaaactccaacagacatgcagctgacggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctactccaaaggaacgcagttcctcaccagcaatggaacaaagctggacggagaatgactttgacaagttgagagaagaaggcttcagatgatcaaactactctgagctacaggaagaaattcaaaccaaaggcaaagaagttaaaaactttaaaaaaaaattagacgaatgtataactagaataaccaatacagagaagtgcttaaaggagctgatggagctgaaagccaaggctcgagaactacgtgaagaatgcagaagcctcaggagctaatgcaatcaactggaagaaagggtaccagtgatgtaagatcaaatgaatgaaatgaagcaagaagggaagtgtagagaaaaaagaataaaaagaaatgaacaaagcctccaagaaatatgggactatgtgaaaagaccaaatctacgtctgatttgtgtacctgaaagtgacgggtagaatggaaccaagttggaaaacactctgcaggatattatccaggagaaattccccaatccagcaaggcaggccaacattcagaatcaggaaatatagagaacgccacaaagataccccttgagaagagcaactccaagacacataattgtcagattcaccaaagttgaaatgaaggaaaaaatgtaaagggcagccagagagaaaggtcgggttacccacaaagagaagcccatcagactaacagcggatctctcggcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagatttttgtcaccaccaggcctgccctaaaagagctcctgaaggaagcaataaacatggaaaggaacaactggtaccagctgctgcaaaatcatgccaaaatgtaaagaccatcaagactaggaagaaactgcatcaactaatgagtaaaataaccagctaacatcataatgacaggatcaaattcacacataacaatattaaccttaaatgtaaatggactaaatgctccaattaaaagacacagactggcaaattggataaagagtcaaaacccatcagtgtgctgtattcaggaaacccatctcacgtgcagagacacacataggctcaaaataaaaggatggaggaagatcaaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacttacaaagagacttagactcccatacattaataatgggagactttaacaccccactgtcaacattagaaagatcaacgagacagaaagttaacaaggatacccgggaattgaactcagctctgcaccaagcagacctaatagacatctacagaactctccaccccaaataaacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaagattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatccctgggacacattcaaagcagtgtgtagagggaaatttatagcactaaatgcccacaagagaaagcaggaaagatagaaaattgacaccctaacatcacaattaaaagaactagaaaagcaagagcaaacacattcaaaaggtagcagaaggcaagaaataactaaaatcagagcagaagtgaaggaaataaagacacaaaaaacccttcaaaaaattaatgaatccagaagctggttttttgaaaagatcaacaaaattgatggactgctagcaagattaataaagaaaaaaagaagaatcaaatagacacaataaaaaatgataaaggggttatcaccactgatcccacagaaatacaaactaccatcagagaatactacaaacacctctacacaaataaactagaaaatctagaagaaatggataaattcctcgacacataaaccctcccaagactaaaccaggaagaagttgaatctctgaatagaccaaaacaggctctgaaattgtggcaataatcaatagcttaccaaccaaaaagagtccaggaccagatggattcacagctgaattctaccagagaggtacaaggaggaactggcaccattccttctgaaactattccaatcaatagaaaaagagggaatcctccctaactcattttatgaggccagcatcatcctgataccaaagctgggcagagacacaaccaaaaaagagaatttgagaccaatatccttgatgaacactgatgcaaaaatcctctataaaatactggcaaaccgaatccagcagcacatcaaaaagcttatctaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattcaacaacccttcatgctaaaaactctcagtaaattaagtattgatgggacgtatctcaaaataataagagctatctatgacaaacccacagccaatatcatattgaatgggcaaaaactggaagcattccctttgaaaactggcacaagacagggatgccctctctcaccactcctattcaacatagtgttggaagttctggctagggcaattaggcaggagaaggaaataaagagtattcaattaggaaaagaggaagtcaaattatccctgtttgcagatgacatgattgtatatctagaaaaccccattgtctcagcccaaaatctccttaagctgataagcaacttcagcaaagtctcaggatacaaaatcaatgtacaaaaatcacaagaattcttatacaccaatagcagacaaacagagagctaaatcatgagtgaattcccattcacaattgcttcacagagaataaaatacttaggaatccaacttacgagggatgtgaaggacctcttcaaggagaacaacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttgacaaacctgagaaaaacgagcaatggggaaaggattccctatttaatcaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccatgcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcaacctacaaaatgggagaacatttctgcaacctacctatctgacaaagggctaatatccagaatctacaaagaactcaaacaaatttacaagagaaaaacaaaaaaccccataaaaaattggccaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtctggaaacaggtgctggagaggatgtggagacataggaacacttttacactgttggtgggattgtaaactagttcaaccattgtggaagtcagtgtggcgattcctcagggatctagaactagaaataccatttgacccagccatcccgttattgggtatatacccaaaggattataaatcatgctgctataaagacatatgcacacgtatgtttattgcagcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgagaactgaacagtgagaacacatggacacaggaaggggaacatcacactctggggactgttgtggtgtggagtgggggagggatagcattaggagatatacctaatgctaaatgacaagttaatgggtgcagcacaccagcatggcacacgtatacatatgtaactaacctgcatattgtgcacatgtaccctaaaactgaaagtataataataataaaataaaaaaagaatgacattattagctttattccattaaaaattttataatcaatagattagtatatgatgttaattcttatgatctgatgaggatgatttagcctatattcagaaacagagactattttttttcatagaacgttagtattctatgaacaattaggtggaaaaagcagttttaatataaatatccatttatggtggcaacaatagtgtagatatggagcagtgactgtatttatatacctggtctaccaaatttatatgaatgcagactttaaactgtttgaaaatatatgtattatttatattaatctttttatttcccagtgttagtacaatactagagagtagtgactactaaatattatctaatcaataccattctgttgtttgcattttgttaaataatcaaatgtttcaagaaacattatataatggtttcccatgatttctgctttatatatattttaggcctctcaaaacatattaaatattatacatgatccatagaagtagaattgcagaaggaagttaaaagacaatttaaaaataattgttggctgtgtttttgcatagataatgtagtaatcatagaaaatggtaatgaatttcagatgattcaggaatatatgttaaacaccataagcatcaacttatgtatgaattctttcaatatgaggaccaaagttttattcttgaatatagttaataatcttaatcttccctatttgaaatttaggtgtcaaattagaaaaagggaaaaaataataattttggaattaagtgtataaattttaagttgtttttctagaaatctttagttataagatatattattataaatatgacatgagcttgaaggaaggtggtgtgggttgaattgtgtctccttccccaaactcatatgttgagttcataactgtcaatacctcagaatgtaattgtatttggagatagggtctttacagagatcattaagttaaaatgaggtcattagggtgagtcctaattcaatatgactggtgtccttataagaagaggtaattcaggtacagatctatagagagatgatatgaagacatggagataagacagccatattcaagctaaggaaagaggcctggaacatatcctttcctcatgggcctctgaataaaccatccctgtcaccaccatgatctcagactcctagcctacagaattgtacacaaatttctgatgtttaagccactcattctgaggcactttgtcaaagcaaccctagccaaactaatacagattttggtactgagaagtggggtgctactataacacacattgaaaaatatgaaagtggctttggaattgggttttatgtagaggctggaagagttgtaaaatgtatgttacaaagagtctagatttccttggaaagattgatggtagaaatatggtcattgaaggaatctctggtaaggactcagaaaaaaaaagatagctgtagaaaaagtctctatcctcttaaaaaatatatatgtcattgtgtacagaatgtaagtaaggatgggcatggtggttgatgcctgtaatcccagactttgggaggccaaggtgggaggattacttgaagccaggagtttgagaccaacttgtttatgtaaaaaaaagtacataaatatatatgtgtgtgtgtgtgtgtgtgtgtgtgtgtgtgtgtgtatgtgtgtgtgtatgaatattggtagaatgttaaagatgctttggtaaggtattagagggaaaagagaaacattactgaaactggaggaaaaacgacctttgttatacagtaatgcaaagtttagccaaattgtgttctagtgttttgtggaaaatagaacttttataaatttggatatttagctgataagatttgtattttttataaaaagtattgatagtattccttctccttgttgcttatggcaaaatactaaaggagagagataagtggaagaaagaattgctaaacaaaaaggaagcagtatctgaagatatggaaaatcctcagcatatccatactgcaaaaaatcagaaaacctgttctggaggaaacatcaaggttgtggctgaatgaccatttgctaaagagattgtatgtatggctcatgggtctattcaaccatctcaccagaagctgggattgaagatgtggttatccaggaaagatctgtgaaggatcctcctggactgtcctcatgtttgatggcttggacgtctgtgaattgcatggtaggccagaaaagttttttgagaattcgatacatgctgaaacacacccagcttgtactgaagaaaataaagatgaaacaaaataaacggatggaacaaaattctacaggagggaaaagcagattaattggctgtgaatgtgcattatcccttaataaaaagattgaatgaccttgcaggcagtgcagaagttggcatttctgccactacaacaggcccgcgagtaggtttgtctcctccttggttctaaatggcaaggcctcctctaaagtttcaaaggaacaggccattgccacctaaggctgaggagatgaggctgccaccctgagggggcccaaagaataggactgctaccatgatggtccagaggacttaagatttggctccagagcagtcaaagaggataatttttaagatttaaaatctgatagaattttccctactagcttttggacttgcttggaatgcataacctctttatttctgttttcttccttttgaaattgaaacgtatatccaattcctatcccaccattgtattttcaaagaagacaacttgtctggtttcacaagttcacagctggagagtaattttgcctcaggatgaatcatacctggagtctcacccacacgtggatcaaatggcatttaaatgagatttgtgacttagagttgattctggaatgagttaagactaggggctgctgggatggggtgaatgtattttgcatgtgagaaaggcatacatttgtggggggcagagcatgacatgctgtgggctgggctgaattatttcccccttccaattcatatattgcaggcttaatccctagtaccacagaatgtgactatatttgatggtcactttacagatataattaagttaaaatgagttacttggggtaggtcttaatccaacatgactgatgtcttaaaatgagctcattaaagtaggacctagtccactatgactggtgtccttattagaagagtaaatgtagacataccaacatctacagagggaagaggatatgaaaacacagggagaagatagccacctgtaagccagggaaaaagcctccccttttggccctcagaaagaacctaccctgttgacaccttgatcttgaacttacaaccctcaaaaatgtgagaaaataaatttatacttttaaagccactggtctgggatactttgttatggcaaccctagcaaactaatatagaaggcaaccaacacaaacaaacaaaccaaaaacttcttaatattttcctactgaggaattaatattttcctatcttactattttcctactgctgagtaggaaggaaatagaaaatttgatatttatagctaccacaaggcatataattctactgtataataaatctaataatttatattcatatctcttaactatttataagacaagtgatatatgtatgtgtgtgtgcatgtgtgtgtatatatttgtacacttttaattttgagctctttcatggaaaggattttttaaactcttctttgtaattacatataatgtatattatgtaaagcttccacattgtataagtttatgtaaaatacttaagtatagattattttacattaattttatttaactaaaacatgtcagtttaacaggttcacatttttttaaagtaacttcttttttttttttttttttttttttttgagtgggagtctcactttgtcacccaggctggaatacactggcatgacctgggcttactgcgacctctgtcttttgggttcaagcaatcctctcatctcagcctcctaagcagctgggactacagctgtgcaccatcctgctctgctaatttttgtatttttagtaaacatcggatttcactatgttggccaggctggtcttgaacttctgacctcgagtgatctgtccacctggcctcctaaagtgctgggattacaggtgtgagccaccacacccagctagccttaaaaagtaacttctaaggcttgctctttctttctttctttctttctttctttctttctttctttctttctttctttctttctgtctctctctctcccctctctctctctctctttctgtctgtctctctctctctctcctctctctctctctctctctctctctttctttctttcttttctgttagccatgcacctaaacatagatgaaaggaaatcagttcatacgggtatattcgatatatttctttgaaaagttatctgtctcactgttgggcttgactgcattctcaaatgactataattattctattctcatatttttctcctgtagaaaagaaatcatgtttgcatcagtgcagtttgtatataaaataattcaccacatttatcaatttaattccaattagctttccttaacctgttaatatgattctttattactataaaagattttaatttaccattcaaaaggattttaaatattttaaaaagcattttgaagaaagcagcaattcaagcagtttcatacttcatcttaataagagcactaatttaatgattgaaaatagagttggttctataatgaggtctcatgagtacttcattacatgataaagtaacacacaaaggcaaccaattcttgcaaatttaaaagagaactatctgagagaaaagaatcaatgtaatagattatccgtaggtcaagtattattaagcagaaataattgtttagtggctaacttttgtaaacataccaaagctttgtcttttaaaaacatatacattgcataataaaaagcaacaggcctttagtaaatggatttttctatttagtaaaaagagccatgaaatagacattgcaactgattgtttaaaatgctttgcacacaggcacagacacaatctctcagtctcctgtgaattagcaaactggtgagtcacttctctgtgtctttaacttggacatgtttacaaagtatttaccatcctactgaacatagtataaaactctaaaacttaagataaagccatgtggatgaacataagcacatccatccatttttaaattcatatatatatatttaacatagataacaatgctatgtattatacaagcaatgcatatatgatgtatgatctaatatataattaaaatatttataaataaatacatatatacttatttaattatttaaaaattatgcttgctgagtatccagtacaaacacagatgcacaaaggcattgtcctggcttgccaggaggtgaaggtctcatgcagatgtcagacatatgagcaaataaataaactaaagtttttataaatgctatcaaaatggtatgtgaaagtgctacaggtaggaggaaggggaacttaacatttttgaagggggttaaaaaaaaggtctcacagaagcactgctatttatttaccacatggatagtaacctttgaaagaaaaaggataatggtgctcaaatgcacaaacttatcatttgctagaccaaataatttactatttctgaatcttcacttatttctatttttctaaacttttaaagttttgattttcttcttttttaccctgaaatatatatatataatatatttgtaattacttgagtcattatcaatcataggattttatttttttcctttatattgcacaatagatttgtttgcaaaacaattcgagaataatacataaaaatttgactgaacgaataacttatgacttttaaaatttcagaaatttgcatataaaatcaatgacgtttctgtttattttataaatacctgaactaaagtggtgagagtgagaatttgggactaataatagaataaaatctatagagcctgatgattgagtagatgtgggaattggctaaaacaagccaatataagattaaatgtgttttagctcagggaccattgataatggaaatacttgccatggtaggacactttgaaaaagagtctgtttcagagagcagaaatgggaatgataaaaaatagttttgaatatattgcatttgagtatttataaaacattatattaatttaatgttactaaaacttaaagatgaattagaacacttataacagttttttttttctttttggcttaaatttgtataaatgtttccatgtatgaggttaattgtaagttgatatgaagaataaatttaagatatcatgttacccttcaacttttttataacttaacaggggaaataaaacttactcaaatataactaaacagccttttgagaggatgaataccctactttctaagtgatcatttagagcaatgtctttctcaaagtcttgtatgggctggtggagaattcaaattactgtactaaatagaattatacttaccttctgatttatgaccttgtatgttaaaaatcctcagttttactatctataaaatatgcataatgttttgcaaaattattgtgagtaataattggctaaaatgtatgaaacgatctagtatagtgttttgtacacgttagattacttccttctcacactttgaatacattcaaatcaaatgagacatataaatatcagaatttttaaaggatgattgctaaaatgcacctacaaacataaattattaaatgattcaatttttttgactggctattatcaatgcaacataaaagtatatttaaaaatcatctatttgactaatttaaaaatatagccaaataaaattgtacctagtagctatctaggacttacccacttcttcgtgaaataaatttagaggcttaacttatctaatttggcaagactaatataaaaaattcaatggcaaattgccaaatcacaacagtgtgttatatttagtgatatagcccattcttttaaatttttttaatgtattttttaaatcaacagataaaattttaggtatttatatttcacaacatgatgttttgaagtatatattcattgtggaatggctattaaatccaaatacaagcttaacaaaatgctggaagaatgatttaatatatttaccatggttacaaaataatttttctgatatattctgttgaaacatgttatgaattctgtcacctctgcttggttacagtattgacacttccttgctgtaagaatatctaatttgtttgcagataatttatcagaattggactggtttacctctttcacaagttgctttggcaaattaaaaagtgtcctggcgtggtctctgtttggcttgagtcaccgatgggtatgttggcaatactaaattagaggcagccagaccctctgaatcttgtggttggaaatgtaccaagtagtctttggcacagagtttctcttattcaagggtgttagttttggaaaactagagagctgagatagaggaacaggagaactgaaatatatagtgaaggaaacatgcatttcagcccaggaggacatacaaggatttaagttgattggctactcctggctgtctccagaaattctttgaagtatgtgttcaaatgctttctgcatatttggaatagaaggattaccttaaatcttaaaagaaacattgataaacttaggaaaaagtagctgtgcagggatgtccatctcctatatatacgcaaactacctatacagaactcaaaactttgaattttgaataatactgctcagtctttataatgataataaatatattttaaaatcattgaattaacatttatttccttattcctttttctctagaagtaaggagataaatacagcctagagatatagatgaactatgattcatatctcacctccatagcttacaaattgcttggcctgcatcaaggccttttcctttcaaagcagctttctatcatataaaaatgaggataatactctcgtaagcaagacgaaagataaggataatgtatttagaacatcaggatcaacttcagaggtcctaatactgaaaagaatttgtagttttcaatcttcattcaagtgtgtggagcagggagagagaaagaaaactgagataacaaaaaagggagaataagctgcgtaaataaagagaagatgtataattttagacaacttgtttagatgcattctacaaaagacacacaagtacacacttctttgagaatttttttcctttcttacaaaaatctatctgtacataatttaaaacagtagacctggcaacctgaaaagggttaatttaacaatcgtataaggaaagaggcatccactatattcaaaatgagcaaagatggcctagtttcttacatttatctccaacatcctcaccactgctaagcttgcaaatgacacataaggaaaaagtcatagccttatgtgatttgactcatccctgttttgaaattgcacatataccaatattaagaacagtatctctaggacgtagcttttctaccaacatgtaacattgatttttatgttttcaaaacttttcaaattcccctgcatagaatgcagtgaattctattacttacagagacttacattagttactctagttttcctgtcaagaaattctaaatcacttttaatataatacaaagacaaatacttaaatgtttaaataaccggttccatataaaacaaaacaaaactactgcaaaacaaaacaaaacaaacaaaacctctactaaaagaatataatgagagccattttattgtgcctggtattttaaattatataatataaatatatacatattatacatacaatttcactaaaaaaaaaaaaacaactgttatttttcttgaagggaaaacaaaggatatataaattgccagaaaacgcacagctggtaagcagcttagctgtcaggaattacaatgtagatgtagatgtgttcaattctaaacttaggactcttcccttacatcattctcattctaattaccccatataaaagacaaaatataaattgttaaaaggcagagtaaaaaattataaacaattgaggtatggcccaggtttttctcgagaattttgtgaaaactatttattatctgtcaatagaaatcatcaaggaagggcatagtggcttacatctgtaaaccaagcattttgggaggccaacgtgggaggatcacttgagcccaggagtttgagaccagcctgagcagcatagcgagaccccatctctacaaaaaataattgaaaaaaaaattagccaggcatggtagtgtacgcctgtagtcccagatactggggaagtggaggtgagagggttgcctgagcccagaagtttgaggctgcagtgagccatgatggcgacactgcactacagcctgggcaccagagcaagaacttgtctcaaaataataataataataataataataaaaggccgggagcggtggcttactcctgtaatcccatcactttgggaggccaaggcgggcggatcacgaggtcaggagatggagaccatcctggctaacgcggtgaaacctcatctctactaaaaatacaaaaaattagccgggcgtggtggcgggcgcctgtagtcccagctactcaggaggctgaggcaggagaatggcgtgaacccaggaggtggagcttgctgtgagcagagattgcgccactgtactccagcctgggtgacagtgtgagactttgtctcaaaaataaaaataaaaaataataatattataaaaataaaaagatacacttgtaataaatagtaatatctacttttgaaggttggccaaaattaatgcaatacagctttcctataaaatgaaataatataattgccaattccccatttattttttaattatagacttatattcaacctcaaaacttgaaagaacgtttataatcacatttttttaaatttttgttgtttaagactttaaccttaactttgaagttgaatttaggctgcattaattatataatttaaattctctaactcaaaagccatgaatcttagatctttggtcaacattagaaatttttttatttgtataaatttaagcggtacaagtgtggttttattacataagtaatataaatcccatgtttgttatatattgcatagcagtgaagtctgggctgagatggtttgcctttgcgttcccatgcaaatctcctgttgaattgtgatcttcagtgttagaggaggggcgggtgggaggtgattggatcatgggggcagatttctcccttgctgttctcatgatagtgagtgagttctcatgatatctgattgtttaaaagtgagtagcacttcccctttgctctctttctcctgctccaccatcgtaagatgtgcatggattccctttgccttctgccatgattgttaagtttcctgagcctctcagccatgcttcgtgtacagcctacagttctacgaatcagttaaaaggtgtttctccataaattacccagtctcagatagttcattatagcagtgtgagaaagaactaatacatgggcttttagtgtaaacatcacccaaataatgcacactgtacccattacataatttctcatccctcactcccctctcactctcctacccttctgagtctccaatgtctgttattccacactctacatacatatccatacattgtttagtttccactgataagtgagaatatgcgctatttgactttctgtttctgaattattacacttaaggtaatggcctccaattccattcatgttgccgcaaaagacacgatttcattcctttttatggctgagtattgtgtgtgtgtgtgtgtgtgtgtgtatgtatgtcacatttcctttttcttatcatctgttaatagacacttagctctatgccatataatagtgctgcaataaacatacaagcacaagattttttttatatataataattgattttacactggttagattcccagtagtgggattgctggatcaaatggtagttccatttttagttctttgagaactcttcatactcttttccctagaggttataataatttacattcccactaacagtctgtaatcattcttttttctcctcatcctcatcaacaacttttttttttgactttcgtaatagccattctgactcgtataaattgtagatataagtattgagagaactcagcactcttgacttagaacaaaagaaaatgatagtatagaagattctaccaaaaactgtgtagattcttaaaaccacatctctttttaactacattatggtaatatagttaagattcaggtgaattgtgaagtgctataagaaatgaagctaatttgagtaaatgatattaaaatttattcactgagaaacatttttataatacttattttggacaaggcacttttctagacacttacggtggccagaaaaaaaaaatgacaacatccctgtcctcatagaaattccattcagtgataccattttagacaataatctcaatattcagcattttccatcataaatttcttacttcctatagataacaaatctagaatttgacacaaattattcaaaaattatttttaaagctggataatttccatagttgtggatgccttaacctaaagttgtgtaggtttgtatagaattgtttgcttagtgtctagcactcttaaagtgtttttatacaaaaattaaaaacagaattgttttttctattttacctaacttaattttgaaaaaaactccacacttttattaaagtttattcatagactttttatttatttatttattttttgagatggcgtctcgttctgttgcccaggctggagtgcagtggcgtgatctcggcttactgcaagctccgcttcccgggttcacaccattctcctgcctcagccttctgagtagctgggactacagccatccgccaccacgcctggctaaatgttttttgtattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttaatagagacagggtttcaccatgttagccaggatggtctcaatctcctgacctcgtgatcctcccgcctcggcctcctaaagtgctgggattacaggagtgagccaccgcgcccagacctagtcatagacaattttaaaattaggatttatttggaatagggttaatataaatatctcacgaatgttgttattagtagtgtaaatgagttttttaaaataatgcaagatttatattttgaactgaatcatattccctcaaagtttatttgttatggcctaactcccaatgtgactgttttcagacataaggcctttaaggagataattatggttaatgagatcataagaatgggaacttaatccagtagaactggtgtcctttaaaaaaagaaagagataccaatgatctcttgcccagaggaaaagctacgtgaagacacagtcagaaattggatatctgcgtatgtacaagccagaaagaggtttcagaaaccaaccccgccagcatcttaatcttggggacttccaacttctagaactgagagaaaatacatttctgttgtttaatccaaaccggtctgtagtattttgttacagcagctgcagcagactaatataatttataacagacctagtaaggactgtgtttttatgttatgtcctcctaaattatctcatagcttcattacaccctgtaaagacatcagttataattttaagaaaaatgataatatattcataattcagagagccagaaaagtgtgtgattccatcatcattttcactttttccacaaaactgagaacactggtttgaggattctgatgtcatagtcataatacatacaaattaaatgcataaagaccgaaaggccataagaattaaatgaaaaattaaacccagaaggagttacataattaaagaaagtttgattgacaaagggaaatacttattagtatgaatgtcatatatttacacagtttgatgtaattaaaaagttatttcacatgcatcatttcaattatctctcacaacccagaagaagatcagaacaggaggacagaaaaatattatgaactcatagagcttcttatccatcttcccttcaagaaaatgaccacaattacaattttatttttatttgtgtaattctttggttattgtttgtctctcccactagattataagatccatatttgttttctcttttcattatatgtacagtgcctgatgtagttgttttgaacttttaaaaattgaagactaaatgcactttctaccttgatcctgaagttttgtattttggaggaccaactaaaaagcctcactcattttctttttttaaaaatgataataggaccaaatttcatataccctaatcatttctgtgaaaaaaatttttggtacacttacaatctcaaacaatatataatataaaggaaatcaatttagtcttcaaactggcaaggaataaattagtagtactggccgactatttcttttgggcatcaaggactgcttactatgggtggaagactttatcaatcttccttataatacagaaggaaaaattcacatgccctaaaacattcattgagctgattctacagcttaaatttgagggcattgtggtgataaggtgaccagagttaagtacatgtatattaaggtcttgaacttttggtctgccatgactccacctccacctccattaccatattcatctacaatattcctgatggtgcctaactgattatccagtatattcattgcaattaaataatgctatcgttcccctagtacgtaattaggaaggggaatttgttgcaactattcttccacccaaagactgacaagcctgtctttagagaagtttcaacaggagatggaaaaagagatatggagtgatgcatgatttctgtgactagattagaaagccttctctcataatcagtaaacttagcatgcagaccaccaaaacattcattccttccttcattactcttgtattttcctatgaattgagtattgggtttagcatagagaatacaaaattggcaagcaaaaagggaatgtcatgtattacttcataaagtttacaattgaaccagaaaaacaaaaactgatcacatatgtgaaaaaggtaattagaggattagggctccatccttgtgatctcattaacgctaattacctctcttagatgagtgaagttaaaatcatgacaagagataaaatagaggcagaacataggcaaaaactttcattaaatgaattaatgaatgaatatctcagtaggtaaaagaaaaaaaaaaaggaggctagattagctggaacaaagagtagccctgaaggaagcaaagactgatcacataacacagagcctagctaatcttaatcttagaaaaagaaaaagacattgaaggtcaatgtctttgctcatacctgttacttaaagggtaaggattattagaggaaggaaaatatcaaatgcagttctgaaaaactaactcaagcaatacagagaaagggaaatgattgtagggagctttggactgatatgggaaaccatatcagtttcatatcagtaatcatgctcttgggattagacagatttggaccttctgatcaatgcatgatataaacttggaagagtggacatttgttaactgctaaaaaaattcttctttgtattatcttcctttacatggtttcatcaaatgaaaggcaccattagctgccaggaataactctataaatacagtcgctaaattatggagctatttcatgcactatttatcattcaaatatgagaaaactaagctatcacaaatgtctgcctctatttgctggaaaactgagttcagtatattgattccaagataatgaacagcaatattcccttgctctgacaccgaaatatctattctttatttttgtgtatttttttcttaacttctaaattgaacaaatgtttcagtatttcaaaaagtaaaacatgaaaaatattaacacaattaaagtataagcacaactatttagtaaattcttcctgaaaattaaatacttttagaaattaaattcctgtcttgaaggaaaagtgaaatgccatgcagaaatgtgcaaatgtcatgaaaattatatctgggttagataaacctcacaaagcacaattttctggaatatggaacaaattaaaaccttttttatgttttagtaaaaatattttatattcaataaaaaataacaatagtcaataaaatacagtttcactatgataaagttaactaaaaggtattatcatttcagtgttttgatgttaaagttatctgttaaaggaagaagaatataattttgtataacattgctatagggttacactattttttatatatactgtatatatgtgtatatgtataatataatgtaatataatataacataataatctttggaaaaaagctcagaattttttaggtacccaaaattttcccattttctctgttgatttagagtttattacaaaatgtccaaagaaacattccaagtaaaaaaccagtatgcaacttaaatttccatttattcattcttcttgggtcgttaagcaaaaattccccaaatgtgacacaactttgctcccctgctttgtctacaacactataattccccgttacagcaattctatgtttacgatcattcaactttcactcctgctatatggcaggtaaatgttacatgttaggagaacaaagagaactaaaacattattattgaattctaaaaactaaaaaaagcagcaggtgaagtctaacagataaacagctgacaaaaatgcaatgtcgtagatactatgaacatttatgcataaagtgctttgtgaacacagataatgttggttgtatctgtaggtttctaacaaaagaaatctgctagaaatctgttagaaatctgtaggtttctaacaaatggttgaatctgtaggtttctaacaaaagaaatagtagaaattgagctttgaaagataagtatatattaaccaatgatgtcagtaaaatattttttcttttttttggtttcagaagaaagcaagaacaaagcaaagatgtcaagaaattaaatatgttggtgagattctaacaatctgtctcagttggtcaggggtttcatttttcactgaatatcctaggttcgcttttaactccaaacttctgctcaaactttttttttttctgggatactatttattatctttgataaatatctgtgtcaaggaaaactacaatggctgaaaatatatcttggcctgggctggtgcccttttgaagacatctcttcttgtctgagctcaattgctctatctttgaagttttaaaggaataatcttctgtattacttacgtcaatcctgttcacatacagctgagcttattctctgtattctctccttaattaggtagtaaacattttaacaggaaattttctccaacaatgttttaattttgtttataatactttccacaactttcaaaataaatatttattgtattgaactgaattaaatcttctttggtaatcaataagttcaccctttgattatgcccctcaattgtaagcttcaggcccatcaaacaatgtatgttttgtattttttacttttataggtttattgggcacaagtaaagtttggttacatggatatattacatagtggtaaagtttgggctttcagtgcaagcatcaccaaagtaatgcacattgcatacattatgtaatttctcatcccttacccccctcacaccctcccactagtctgagtcttcactctctatgttcgtgtgtacacattgtttagctctcacttataagtgagaatatgcagtatttgacattctgtttctgacttatctcacttaagataatgacaagttccatccacattgcctcaaaagacatgatttcattatttttatgactgagtagtattcaattttgtatatgtgtatgcataaatagtctgttgattgagtcgattccatattttttctattgtgaatagtgctgcaataaatatacaagcatggatattttttatatgataattcattttcctttgggtagatatccagtagtgagattgctggattcaatgaaaaaaaaaagtccaacatcactagtcatcaggtacatgcaaattaaaaccacaatgagataccatctcataccagccagaatgactattattaaaaagtcaaaaaacaacagctattggcaaggatgtggagaaaagggattggtcatacactgttggtgagaaggcaaattagtgcaacctctttgggaaggagtatggagatttctataaagaacttatagtagaatgatgtactttgtacattgtttttcaggacaggatgtcactctattgcccaggctggagtgcaatggcataatcacagctcactgcagcctccacctccaggcttaagccatccttccacctcagtctcctgagtagccttagtaaagagagaggaatacctttggccaagggagagtaaaagactgcagttaggaaagtgtggactgtgtttagattttaaaaagctttgaactttgtctagagaataggtcatggatagataacagaagaagagacatgacaaaatgatcagattcatgaggtagggagatttgttctcttcttttcagttttcattttcatgtatgtatttacttatatatatattttaaaatttatgggtgctatatatatataacacccacatatacatatacacatatatatgtattatataggatatatatatgtaatacataggatatcaaattaaggggtttagattaggaattacagtgggtatctgtttttagttagcctgcatcttttatatgctttaattttattcattattaggttttttttttttttggtaaaacatcctgaattatctttgaactatcccttgacactgcaaatcatgttgatcttgtctctcagaaatttgaaccttaatcattgacccaaggagaaaaaaatggaaggagctgaagcaccaattacaatgacatcaacagatttctttctcatttctacaaacttctctacttcctgtcctatacaaggactgtttttcttttcctttaaatctaggagttgccatggatcctgtcaaaaaattccttttgttttccataatttggccagagtcaatttatgttgcttaaaactaaagtactttattcagaaaccaacagaattacattctatgacattttcacataggtgttaggagtcagaataaagcaagattctatttctcacatgtagttttcaaagatggaataaaaattcaaaagatctgtccagtggaaaatgttattatagaatagatgttatttcaaaacatcattatgtagaaaatgctgtgctatcttttgaaggaaatcttgtcaatgtacaaagtaactgtgcttggaaaggattcttggaaagaataagtttctcatacttttgtagccaatgtataaaatcaacaatttacattgagaaatcaaggattagattatttctggagagcatgaagaacatattttcaattacttgaaaatgtgtagctcacaagaagtgtattcatagtgaagtaattttcctgaaatagtataaaaggttaagagcaaagtgaaagtaggaaggactcaggatacaaacaatatcaagcaaaggacttatttttatgatttaaaatgtcaactgacttatatgttaggtattcacgacacttcttgctaacattaaacaataactttgctactaataatagctgaaatgtatttagaactaagtgccaaattctgtgctgaacactgtgtagattatctcactcaaccttcactagactactatatgaacaggctgtgtaattcttaggactctttaatcacacaagaacagcaaacccgatctatatttgcttcagcaaataggaaatttatgggctcacataaacaaaacttcctggaagagggttgtcttaaagggcagtttaatgcatgggcttaaaacatgtaaacaatatttacagtttcaagtccctaccttgaatcccctttctttcatgaattgtcagtacctaactcctcacaatcacaggatagctatttcagcccagttgaacactcaactaactctagatacagaggaaagataaatacatgttttatctgtgaacatggtaaagtcttggcttgattctccttgactgaattgaatggtactcgttcctgtaataatcgagatgacatgtgttaaaggatttgcactatttataacaatataattgtgtgcatagtagtaataaagatgataaacataatgagagcagtgaacacttgcagtacttccataattctaaaaactttgaatagattaacttataactttacaataactgcaacacataatatgctattactatctacattatattgatgagaaaacgtacacacagagaggttaattcacttgacctttttcaaccatctgttaagttgcagaatttgggttccatcagaaattatctggccctaaagggtacaaactaaccattataatgtggtgtcattcattctttgagctgttagtgagaccattcccttgcaaaccacatgtactgaaagtacttgaatgctatcacagaaaatgcagagtgcttttctccagaagataaagaaactgaggcacaggaattaagtagctactctgaggtaataaactagtgaatggctaaggtagaatactacctatttgatggtagaactggaagtcctaactactagaatatatgaatgcataaaatgactgttattggatatatttgaaaacaaacatggtagccacaattgcatttggagtctattactttgatgaatttttatttttcccatgaatcatgtttgctgataatcaaagacctagtataaggctctgaacctaaggagaagagggagggcaaatgctacatggaataataattcaaaaaaaactagatttaaatttcaatgagaagttttattttgggttttgcttctttcttaaaagcataccgaaaagaaatcatcttaaaactcaggctttgcaaaaaatagatatgagaatctattttctattagcttccattcacatatctggaaccaatcctggttgactgaatcacagataatatcccatagttttgaaggtatatctctgaaaccattattgctaagctacagaaagaagtttcatacagtattgagaaacctaagccacagagaaatagaaattggcaagcccaagactgtctgtacaaaggccccattatagactaataaaattgaatctctgcgttcagagagtcaatgttaatgttcaaattttctgaccctaatcctaactctaggttcagttataaaaaaatggaatctagggcctgggcatccctatttttaaacaaatacccagtgtttttaatgttcagacaatgttgaaaaatactgctctagaaaaaaaagcactgtataaccaattctcccattgtgtaggcaacagcatcactgggttattgggaagttgccagaaaaataagcctgaagaagctcttctgactctcccaactctaaacatagataacaatgaattcagaaatttcggtgtgctctagtaaggggacatgtaggtgctgagaggttcaagggtgatggttaagaccaagagacctttgtattttggggttttatacatgagaaatatgaccaagaccacagatgccaaaaacaggtgccaaaaattctctctgaaaagtcagaaagaacaagtatccagtcaccaatgcaggctcaaaaacaaaggagctactcaacaacaactagaatatcataagtatttgaggttcccatgatatatccaaacaccatcttggaaaggaccagatatcatacaggtttggtatttgagcatttacacggaagaaaaaaaatttttaatgcaaagaaacatgctgctttaaactgtttttttttttttttttttttcctcttaacccacatcaggataaagagtgagggcaggttgtgggacttaagagaaaaagtacataaattatacagaataaaaagctttatttcctttgcatatttaggtgatagtatgcccatttttgacacacaaattctaatttcacatatcctattttattctccctacattttttgacctttttcttctctcattctaacagcaattactctgcatctttgcttctggacgggtttgtgactggaaagaaggcatttgcctagaaccatccctttctcagcattagttccagaagtgtaaactcattgaggaaattttacagagtgctctgaggaaactgtaagcaaagaagaagacctctgaaaagaaacatccagatggaatttgcctaatagcaagagaagaacccaacttcatggctggggaaaagcgcagtgattgtgagcctgtaagcaggagagacacaggcattgtgggtcctcagcagcagaggggagacggggcaaaattcccaaatgaaatcagtgcatgtgcacctaactttttctttattaacaataacatttgataacaatttgtacttacaggtgtacaacgttgacagaaaaatagcataatgctttcaaacctaatgaaggcactacaaacaactaaggcagtattttcttacagtcaggtaaaatcaaaagtccagtcaaaaattaggtcaatttaaagaaaaattacgtcaaatttattgtactcctaaataaactattcatacttactacctaaaagatagttttgaattgatagattaaatttacagacattcagtaattaagatattcaataaccaatacttgtttaaaatgttaaatatagaagaaaatgtatccttgagccaaaatttgaggctgagggaaaggtgacacttgcctagaaagatgagccaatacaccttagcctttacccaggtaaagaaagcactgctatcatggattttatcagaaaagagaaaatttcctggtatatccagctaacatatactcctagtatatccacataaacacatattaccccaaaaatatcaatatctggaattcgagtcattgatagaatgctaaggccccagttaaaaaaaataaactattgagtaaatatatggactcatacaaactagtgcaagcttgtgcattttaaaacctggttgtggccgggcgcagtggctcacacctgtaatcccagcactttgggaggccgaggcgggtggatcacctgaggtcatgagttcaagaccagcgcaaacaacatggtgaaaccccatttccactaaaaatacaaaattagccaggtgtggtggcggacacctgtaatcccaactacccgggaggctgaggcaggagaatcgcttgaacctggagggcagaggttgcagtgagctgagatcgtgccactgcactccagcctggacaacagagtgaaaaaacaaaacaaaagaaaacaaaactagttgaaataacatccttttggctaaaatttaattacccaagaaatctaattaataggtacattttgagactattctattcctcaaatagtgcagtttcttcacgccttacaataccctatagcttatttgctagaaaatactatctcatctcacattttgtctttacatttttaatcatttatatctgacattcaattggatagtgatttttttatttgattagcaattattttaagataattatgcagggattcatttttttagtttattcttgcttcgtgctattaaagatgcaacttttgttcacaggagggcatcattactcagaaaagaagtgatttatggagtaattaaagcaaacgaaatcttcagtaaccaagtgtaaattgtaagtgaatgctcacttggtctgacctctctactctttctaaacataaaatatttattgttgccattagtattttaataatcctgggttttagaaatatttttatttaattttcactttgtttatatttattttttctaagtaaaagatactaaaatgaatgaacatttttactaaaactaggaatagtgccagataaaacctagatgattttaaaactatgaataaaatagagttacaattacacacatatactctcacgctcatttgtttccagttaaacatttctgattacacatatatgtacctggcaatgtttcctatgtaatagtatatttgtttctatatagcatataagaattctctcataattattaatgtattcattaaatttacttatttattgttcaaacattactcattaaattgtgaacaataaatgattagagattcccctgccaccagccacaatctgtaactcttagttgttgacaattatattttatagattaagctgaattgaaaaactgaaacagtgatattggtaaatgttgcaaaaatttgaataactcttccacacattactaataaaaaatgtgaacaaataaataaataggccaagaatttggaaagcaagtaagagatgcatgaatgtttgggttaatatttttatacaaatacagccctctaaattcaaacatatataaaggagtacatatacatttttacagataagtaactagaaattatgactttatggtgcataatacaatgatgaattaatatagttacatcaccaatgatttatttaatatttagagttataatagattttataaaaatatattcagacatcaaaacattttttattaaaatgcttatattgtgggtgactgtatgttctttttaacattttattaaaaatggatgctttaaaatatgtttaataatcttgctcaaataaactagaaattagtttatatattcatggatatcatcagaaattttaataaaactaacttttagaaatattttattttatttatgtttcttttctatgaaaaagtaaaagtgatgagattaactcatttccacaacagatttcatgcttcagttccaatctgttttctaaaaataggaagtcaactcaatattaatgtttagcatttagttaatatctagaatatattactatgatactgatcatttttactccccttaaaatactgctgttaagaaaagaaatcaagatagaaaaatgttcttaatataaagcagcacaaagaggaataatattattatctgagaaattcctccttaaatacatgtttggaagtattctctgagggaactttgtactcttctttcgctttcctagagcataatgtgatttgttcagaagttaaagcaaaattaattaactgagtacaaacagaaatcaatttttttgtttgatgcaataaaatatgacttattgatataataaaatatgactcagatttataaagtttcattgttgtggttgtagctatattttagccacacaaaagccaatatcattgtgaaaatcagcagtattctataaaaatggaaccactgcaccccattctgtttgaatacttgtttcaaaaacatatttgatctgataattactttacaataaatcatagaaatatatttaaaatgatataagcataatgttcaattttaaaactaatttattataataatttgcatgtttaacagcatttaatatatgaatttgttttcaaaatacataaaccatttaatttttaagtctgtgttttcctttattactaaagacaaaattattttctactagaaactctgcatttattatattctaattacaatcttattgttctggttcttgtgtaataataatggagaaataacaattttgtcccatgtcataattaagaaagagtggagaaaaataacctgtgtaccattgattagttcaactgctgtagttacacttgtgaaattttaagacagtagctctcaatgactttccagtatttctgcccatattgccattcccaaatacctgagtgatatctacaatattaggcatattgtagcaaaatttctttcatctttagcatttcattgtctttaacctccacaagtgacatcaggttttaaaattcagctttgttcatttatttatatgtactcaagcttaaaaacggcattgaagtcaatgtatttggaaatataggacatgagagacagagaaaggagagagagagagaaagagagagagagagaaatatggagggagaggtacaggaagaagaagagagatggatacatctaagctgtttctgattattttcaattattgcttgatataaacctgcttctatccatctacttccccacaaacctgttccaggaattatttgtctagaaaaatttgatgcctacttgctctgaaatttttgactccaggatcgcacagttgttcatgtattagtagattttgaatcctactgctttctgcagatctttttatgaatgcctgtaaagtgtgtcagaattaggtttgaaagcaaaatcatatgctgccatatggaaaattagaaagagagcaacgtaagactggtgatttttaagagcatggaaatacatattttcacatgaacttcaaaaaatttacacgctttcttaaatatcctttgctgagctgaacctaagcataaaaaatacaataattctgatatagagaaaagtttctagcacctgaacttgacctaacctttaagaatttctgtgacttgttttttttttttcatgtctgctgtctcacacttgatgtgtcaccagccacactatattacttctgcacgtgccaggttgtgtgttactactgtgcttcaattatgttctttactccttccttttccatttctttactaatgcttcttgagcacctattaagtgtcagtctttgtgctagatgtacagtgggaaataacatacaacatgcccttgcagtgtttgccaaagcaaggttcatattctaaagaagaaagtcttgtcatttttgacaacatggatgaacctggaggacattatgttaagtgaaataagccagaaatggaaagacatatacagcataacctcactcctttgtgaagtctcatggaagtagagagtagactgatgacttccaggggctggaaagacattggtcaaaggatacaaaatttcagttacatagaaggaagaaattcaagagagctattgtataacatggtgactatagttaacaatatatagcattcttgaaaaatgttaagagaatgggtgtaccagttgtcagcacaaaaatggtaacaatgtgaggaaacgcatatgttaattacctagatttagtcattccacaatatatatatacttcaaaacatcatggatgtaagtgttctcaccacaaaaatgataactatttgaggaaatgcatatgttaattacttagatttagtcattccaaaatgtaaatatacttcaaaacatcatgtcatacttagtacaatacatacaattgtatctgtccattaaaaatatttgaaatttttaaaaagaacatgataaggaaatgaaaaggttctctgcctccaggtggtagggatggatggcttatctttttgactaatacactgggtgaatatctcatccagaatgagtatgattatttaatttccatcttcccaatacaaggagaattaagagcagctggagaaaaattacagccattgaaactgctgctttcctttctccatcattcttataaattctgctgtacttttatctcctctgttctataatttttatcccttttgtttattgccttctctccagaagtcataagcaatttcaagcgccttcccattataaaaaaataaataacaataaaagccattgccatgatcctacaatctctggagatattattcaatgttattcttctatttttctttcaagtttttttttttactttttattgctatttctacttcctcacattcaactgaactgtcatttcaataccactggcttctatatccaccacatgactatatataaacatatgaaagtcaataattgccaaatgtaacagatattttttttcaattcaactattaaaaataccccagaaggatttgccatgtttttactatctgtttgtagacccattgcaaccatggagaccacaggcagctgttacttcctgctctatctgcttctctttaattatgttttatcttcatttccttagcattatatcctttatgtagccatcttctaattatttgggtaatttaaacagttctcctgatttcagctaatgaaaatcaatcctgtaacttgtcctgaaatagcataaggcactttattgataatatgttcaagtctgaaatctttgatatttgaacctctcttcttctgatattctttattgtagttactgacactataccagcatcttagaataaagtctgcctttctttaatcttacaattcattgattgattgttaaattcatatacatttctgtttatatactcctgagttgatttcctaatctttatgtttataatcatgtcattaacttgtgttctttatatcttaactgtgtacacctacttacatatcttacctataactatccataaccatcttaccagttgctgtcaaggtgtatatcacataatatattttccctacatacaaccctttgttgacttcccctgtgtgtgagattaactgaccagatcctttccatgacacgtgaagccatcacaggttgcacacccatgaaaccagccttgttcacgttatgatcaaacagcatatactgcttacattcaccataatttactcattttgtttagtattgtaaaattttatttataattcactttgtagttcatcattttcttagtttgttttgtctcctctgccaggaatgttcttcccatcttcctctttaatgaatctactttcgacttaatgttctagattaatatctggacgagtgttactacctcaggaatcatttcatgtccccgccctgcacatgcacaactgtataaacctggatattcacaaacttcattatgtgcatctctttttcttattcacttctctattttataacaatctgattataagagagtcttctgtaatatactccaaattcctttgggggcagtaattccatattatttatcaatctttgtctttgtatacaattttgcaggtgctcaatacctacagccttctaattccaaacaatatatgtgaaaaatgaatgaagtatgccattgtaataatgcttgaatgctgggagtttagaataccagctgtttattgttgtttaaaacatggaataactgttatccacttcaattggttgccatgaaaaagtgtgtgtaaggtcttgaagaaatatcaacatgaataaaataaaatatattgtaaaaatcaaggtaaatataacatcttttattattctgtaagaagcaaatgatgtaagagttgccatgtcttaaaaaataagtttcattcaagagcaaaagctactaaactggggccactttatagaagggacctttgcttaaataatttaatttgccttctagcatctggccaccagttaaaagaaccagttacaaattagcaaagtctgttatatattaaggtgaaattcagcatacaaaaatcaatatgaagagaaggatttgattttcataaatttaacctaattatttgagataattattcctcccaacattttcttaccttcttttgccctcatcagcacaatcaccaagactcttactctttacatatttttccagtggtttctgcttgttataaactacattgacattttgaactctcaaaatatttcttaattagttaaggcataatttctctggttttctattttctctaggttttcatgttgaaaactgctttgaacattaatagaaaaaaattttcaggtttaaatagtgctttaaaatctcagttttaggaagaatattctctgacatgcattatttcctatgtggatactgcaaaggttttagttacaaatactttctatctcacagctgttctcctttaagctatcattatgtcaattttcttttaaaccattatttatgatgcacaaatagcttttatatttcaagaaaggaatttgtcagaagagagaacaatactagaagctacttaatagtaaatcatatctcatattttgttctatgtgactttttttatggccttcaatgtttgaccctaatgtagatacgtgattgttaatgatttattttcctttccttttctcttactatttttattgtggattgcgggtagtgttaatctttgtagtttatgttgcaggtcatcagactattaagaaccatatctgtacctaatggagaggactatatattgcctgtagatagtgacatgaggtagacactgtgaccaaatggattttgtgtctctcttgaatttgagagtgagagcatcttcctttgtgttatatataattgttttatgttaggcagatgcattgagttgtttaaatatgagtcaaaacatgaaaatgggtgctgagtgacacaaatgtaaaatctttggttcagtgcccatttgccctcagatgcagccattgacttttccatccttcctactatttacttcagggcaattaacgttggaagatgtgttccttagactaccatttcagctgacttatggcttggttcaaccagtcactgataaaggaagaaagcagagtatttctccttttcctgagcctctggcagcatttctgacagtgctagtttacatatatggctccaactctcactaaagaaactccctcatgaaaccaggttccactgagtgattctggatcctgatgtctttaatcacaaaagtaaggcagcttctttcttttgtgcctccatctggtcatagcctccagctgttggtaatctctgaattgatttgtgacctgcttgccttctccatcactttataatcaatacttgaattaaattccatctgttttaagtacccagaatggtttctgttttcatattgagctctggtagatataggaaaagacaatgaaataccaggatcagtggatataggtcctgctcatgcagatgaattgttggagttaggtatcagagggagtaaaccagaggagaggaactggtcagacaataggatatttgaaatggatattgcatttacaattattaataataactacgtttaaccatagaaattaatgtccaagatactgggaggaaagtgccattgtaagagaaaacaaattagaactgagaggtcagagtattgaaaagagcctgacaaagactttctccatgaccaaaattttgtcaggctttctgagtaattttctccactaggccccaacctctggatttctttatctatatttgccttacccaattttaggaagaaatcctgctaagtcagttttagccagaatccccatgttctatatctaattgtccacaatatctgattaaaatcctcatcacctaccatccttcaggtgatatcttatcactctggcctgccttcagcaaaaatcctcttaggtctgtttaactagaaccttgacctccagccttgatattttctgtttctcattcactgactttatggctgcacttatggttgcaacataagcgtgtggtgtaaaggcatttgatttaaaattagggaggacattgtttaggaaagaagagaatggtctagaaaaggcaatggaaagaacagaagacagctctccttgtctaaacgtcatatatttgcaggaaagaaaacaaccacaacttgagagagcttcaagaaaagcagtgtcctcaagggagaacattttttaagtaataaaaaagggaggagaatatcgagagcgtgttgagaatgtgtgtgattttaccaatgtatggactgaatccccaaggactcagtggaagagattcaaaatttaggaacagtaatgaatatgagtgataaaagcagatatatagacatatagaaaaagaatccaggggataggagatcaatagaaagttctgagtttgttgaaggcaggtagggattttttctgttggttacaaggcagatgatagtattatgtcttggaatgataatgagggctaaggtgaaggggagtacagatgggcagctgatgactaagaactcctggacatgttactcctgcttataaagttggaatgagtcattcttttcctctcaatttccaggtattacattggttgtgatctgacatgtattacctttcgaatggaattattttcccattcccacacaggatcaatttcttaatacttacaagttatccagaaaagccagaaatgtccatcatacctaaccctaattcttccagaaataggtaatacaaaatgttaagggaaatatttttattttatcacctaatggagtggcagattttagtgatttgccatgggaatttttttaaaccttatgtaaatatcaaactggcccattgttttctaccagccactaactacaattgttttcctcatttctttgcattcctaaatgctgtcagccactattaggaacttgtcatggtgaaattcaggactggcactggatcatggtcaatagttattctctaaagtataattgacacctgtgtaaacttataattagctttataccacacaaggtgccatatatttagaattgttgaaagattagtgaagagtgagtattttaataaccttaaacttgccagctttttgtcagtacctgggttaaatgggatatctgcagatttgctactcaggtatgattttatttgattcatttaattcagtctgtgattactgaatgcatactgtgttagatactcaaagtccaaaaatataactaaatattctgttccttttgaggtgctttagttatggtttttaaagcttttaaaattctgtacatagtactgtattaggcctacagtttgaaaatgatcattcattaatttattcactaattatttcaagcattctgtgtccttagcaaggtagcagaatatataatacatcaaaaataataatgctattctatattttaataagcaacttcagcaaagtctcaggatacaaaatcagtgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaacgagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcataaataatgccgcatacctacaactatctgatctttgacaaacctgagaaaaacaagcaatggggaaaggattccctatttaataaatggtgctgagaaaactggctagccatatgtagaaagctgaaactggatccctcccttacaccttatacaaaaatcaattcaagatggattaaagatttaaacgttagacctaaaaccataaaaaccctagaagaaaacctaggcattaccattcaggacataggcatgggaaaggacttcatgtctaaaacaccaaaagcaatggcaacaaaagacaaaattgacaaatgggatctaattaaactaaagagcttctgcacagcaaaagaaactaccatcagagtgaacaggcaacctacaacatggaagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcggagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaattcagtgtggtgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcataattctcagtaaactatcacaagaacaaaaaaccaaacactgcatattctcactcataggtgggaattgaacaatgagatcacatggacacaggaaggggaatatcacactctggggactgtagtggggtggggggaggggggagggatagcattgggagatatacctaatgctagatgacgagttagtgggtgcagcgcaccagcacggcacatgtatacatatgtaactaagctgcacaatgtgcacatgtaccctaaaacttaaagtataataaaaaaataaaaaaataaaataaataaataaagaaagaaagaagaaaaaaatatatatttttcttttatgaattagctacatcattttattatatttggctatttctcattataagtgctatattgtaattgaaataagtctttgtcagtgacaaaatataatacctcatatgcacacatatattcttcagttatatgtataacacttcataagtatttttcattgacaagacaatgctgatttcaactaaatttatttacagtaatttctaagtcaaattgttaagtgacagatccctaaattatctaagccatcaaagaaatttgcacatttctcaacagttcagctattttacctatatagaaaggcaaacttatggcacatttttaaagaaaaattttgagaataaattcacaatgtttacttctttagaaaacctatacttgacgaactttggtaagtaatgcaggaggtggcgtcctaagttttggatgtgattaaaattttggttaagcatttaactgatacatgtataaacttcacttttgcagaagtaagattactggaatttatggtatacacatttcaacactcataggagttgccaaatttctctacaaagtgtttgttgccaattatattgttatcagaaatgcacatttgtcctttgtgtatccatattaatattgtttatgaatactagttttcaatgactgtgatataatatgatattgtttgtttaatgttaattgtcttgattactagtgggattgaacaactatttctttctttttttgttgttttttacttttattttagattcagcagttatgtgtgcagatttgttacctgggtatagtgtgtgatgcttaggtttggaatattaatgatcatatcacccaggtactgagcatagtatatgataggtattcaacccctgttccctaccctccttaatccctctagtagtctccagtttgtattcttgccacctttatgtctatgagtacccagtgtttagctcccatttatgagtgaaacatgtggtatttggttttctatttctgcgtaaatttgcttaagataaagggtctccagcatcattcatgttgctgcaaagggcatagtttttttcttttttatggctgcatagaattccatggtgtatatgtgctacattttctttatctaatcaactattgataggcacctaggttgatttcatgtctctgcttttgtgaatagtgttttgcctcaatgaacatgtcagtacatatatgtttttggtagaatgatttattttcttttggatagataccaagtaatgggattgctggaccaagtggtagttctggtttaaattatttaagaaatctctgaactgatttccacagtggcttaactaatttaccttcccaccagcagtgtataagcattcctttccctgcagccttgccagcatcttttatttttattttttaataatagccattatgactggtatgagatggtatctcattatggttttgatttgcattctctgatgatttagtgatgttaaacattttttcataaatttattggccacttgtatctcttcttttgagaagtgtcttgaacaacttttgctttatcagttaagaatcctggtttctacctctttagttgtccttaaaattatttttgtaaaaaaaaacctttttattcattttcttatttttatttatcaatgtatagaatatatatattctctatactaatgctttgttgcaaatatatgggttgcaaatatattttattgcatttattatgtactcttttattagaatttttatcaataaaattgtagtttcaaatgctactataagaaataatagagagaagacctgtgtacactttatccagtttctcacaatggtaaaattttgcaaactatattataaaacaacaactaacattggtgtttgtacaattcatggatcttactcagatttatccagctttacttacatctgtgtgtgtgtgtgtgtgtgagagagagagtatatgtgtgtttatgtagttctatataactttaccacgtgtgtaagttcatatatacactactacactcaagatttactgaacagttccattaccaaaaggatccctcctgtcacctttctattaccacgcccatctcttcctgacaattctctgccactgatcacctccacttcagtccctgtccctaaccactagcatgcactaacctgtttccatttctaaaattttgccatttgaaaatgtcttcctttctggagctggaaaccatcattctcagcaaactgtcacaagggaaaaaaaccaaacaccacatgttctcactcataggtgggaattgaacaacgagaacacttggacacaggaaggagaacatcacacactggggcctgttgtggggtgggggtagcgggggagggatagcactagagatatacctaatgtgaataacgagttaatgggtgcagcataccaacatggcacacgtatacatacgtaacaaacctgcacgttgtgcacaggtaccctagaacttaaggtaaaataaaaagtatatatataaataaaaaataaataaataaattatcaaaaaaagaaaacgtcttatatatgaaactatatataagttgctcaccttttgaatgtggatattatttagtttttatttttattttaatcctggtgtacatgtgcaggatgtgcaggtctgttacataggtaaacatgtgtcatggtggtttgctgcacctatcaaaacattgcctaggtattaagctcaacatgcattagctatttttcctaatgctctctcttcccccactccaccctcagacaggccccagtgtgtgctgcgccccagtgtgtgtccatgtgttctcattgtttagctcccacttataagtgagaacatgcggtgtttggttttctgttcctacgttggtttgctgaggataatggctccagctccatctatgttcctgcaaggacatgattttattccttttttgtggctgcatagtattccatagtgtatatgtaccacattttttttatccagtctatcactgatggacatttggatggattccatgtatttgctattgtgaatagcgctgcaatgaaagtaagtgtgcatgtatctttgtaaaagaatgatttatattcctttgcatatataaccactaatgggattgctgggtcaaatggtatttctggttctagatctttggggaatccccgcactgtcgtccataatggttgaactaatttacattctcaccaacagtgttaaaccattttcctatttctctgcaaccttcccagcatctgttgtttcttgactttttaataattgccattctgactggcatgatatggtatctcattgtgattttgatttgcatttctctaatgatcagtgatgttgagctttttttccatatgtttgctggccacatgaatgtcttcttttgagaaatgtctgttaatatctttgcccactttttaatggtttttttttcttataaatttgtttaacttccttgtagattctggatattagaccttttctgatgaacggataaattcctggacacatacaccctcccaaggctgaactaagaataagttaaagccctgaatagaccaataacaagttttgaaattgaggcagtaatagcctaccaaccaaataaaagaccagaaccagatggatttacagctgaattctaccagaaatacaaagaggagcagacatccgtccttctgaaactattccaagcaattgaaaggagagactcctctctaactcattctatgaggctggcattatcttgataccaaaatctggcagagatatacaacaaaaaaggaaaacttcaggccaatatccctgatgaacattagtgtaaaaattctcaataaaatactggaaaaccaaatctagcagcccatcaaaaagcttgtccaccacaatccagttggcttcatccccaggatgcaaggctggttcaatatacacaaatcaataaatgtaattcatcacataaacagaactaaagacaagaaacacatggttatttaattagatgcaaaaaaggacttcaataaaattcaacattccttcatgttaaaaactctcaataaactaggtatttaagaaacatacctcaatataatagccatttatgacaaacccacagccaatatcatactgaataggcaaaaactggaagcattcctcctgaaaactagcaatagacaaggatgccctctctcacccctcctacgcaacatagcattggaagttttgtccagcacaatcaagcaatagaaagaaataaaaattcctcttttcaaataggaagagaggaagtcaaattgtctttgtatacagatactgtgatcctatgtctaggaaaccttgtcgtctcagcccaaaagcttcttaagctggtaagcaacttcaccaaagtctcaggatacaaagtcaaagtgcaaaagtcacaagcattccaatacaccaacaaccagcaagccaagaaccaaatcatgtatgaactgccattcacaattgctacaaagagaataaaatacctaagaatacagctaaaatgggacatgaaggacctcttcaaagagaactacaaaccactgctcaaggaaatcaaagaggacacaaagaaatggaaattcatcccatgttcatggataggatgaatgtggatttttatttagcataatcctttcaagattcatctgagttattgaatgtgtatagagtttgttcttttccattcagagtagtattccatgctatgtatatacacagttagtttagttgttcacctgttggatatctgagctatttccagtttgagctctaatgataaaaactaccatgaatatttttgttcaagtttttttgagaagataagttttcaaatgatagtttagtttgtatagtaattatatgtttacttttacaagaaattgacaaattggttcccagagtatatccaccattttaccttcccaccagcaatatatgattgacccagtttctttgcatcttcccctgcatttggtatcctattttttaaaaaaaaatttatttgccattctgctgtagtgatattgtggttttgatttatattttcctgctgcataataatgttgaatagcttttcatgtgcttatttgccatttttatatcctcttcataatttgggccattttataattagattttttggcttgtttggctgttgaattttgatttttctttttgtgtattctagacacaggactttgccagatatgagtttggcaaatatttttgctttgtctggtgttaatctttttattttctttatagatctttggcagagcccatatatttctatttaaattatggaataaacttgtctatgtctatgaaaattctttctagcacctttactaaaattgcattaaacagctttagataattctgcagacaaatggcatccgtactatattgattccaattcatgaacaaaagttgtctcttcattaatttaagcctacttgattttcttcatcagcattttgtaactttcattgtaaaaatccatacagagtcttttaagtgtttacctcagtattgcaaattatttggagtaattgcatgtagtattgtgtttccattaaatttctgcattttcatttttttatattgaaatgtgttttttaaaattgatcctgagtcttaaaacatttaggcatttggggaatttgacttgttgtgatttcttatgttataagaaataatcatgtagtctacaaatggtgagttttgtcttttttatttttcaatctgtatttctctatcttgccttattacactgaatagaattttcaatactatgttgaataagagtagggtgaacagatatactttccttatttccaatctcatataggagagcattcagtctttcaccataaagaattatatcagttataagcttagggtgatgttatttttcaagttgaggtaattcccttgtatttctaactttttaagagcttctatcatgaatggttattggattttgttaaatgctcttgtgtcaatggatatgatcaacagatttttcttcattagttagtggatatggtagataacattattgatttttgagtgttcaaccagccttgcaccgagaaataaatcccacttgatcatggcctataattattttcatatatattgtagttgatcttctaatattttgagattccttatatatcaacttttttgcatgcaaaattgtgagagatatatgtctatagttttctttgattttgtactatctttgtcaattttggtattacggtaatactagcctagtgaaatgattaatgaatgaatattccctcttctaaaattgctaattagcaattgcaattagcaattgctctgaatatttccttcctgctttttgctctgagtttaatttgctcttctattttctagtttcttgatgtagaaactttgatttttgatttgagactagtccttgtcaaagattttatatttgacataaactatttaagagtgtgtgtttaattttcatgtgtttagagattttcctgtggtcattctattattgatttctgcttcaatgtcattgttggcaggggacacattctgttgtgattctctagtgaaacaattttagattggtgatttcttttctgggagcttttaaattaataatttcatttttaaatgatcgactataaggcatcatgtttgagtttcagtgatttgtgctttctgaagaacagttccatttttttctaattgatgttcaccaaggcactcatagtatttttttttttttttttttttcttgagacagagtctcactctgtcacccaggctggagtgtagtggcacgatctcggctcacttcaatctccacctcctacgttaggtaattttcctgcctcagcctccagagtagctgggattacaggcacctgacaccacgcccagcaaatttttgtatttttagtggagactgggtttcaccatgttggccaggctggtcttgaactctcgtcctaaagtgatctgtctgcctcagcctcccaaagtgctgagattacaggcatgacccaacgtgcccagccagtattctattattaatggctgtaaaatttatattatatccccaatttcatttctcatattgacaatttgtgttttcttttattatttttgctagtcttaccagtttattaatttaatttgaagaaccagtgttcatcaatgttctctatcattttccaattttcaattttattgatttttgctctgaatatttccttcctgctttttgctctgagtttaatttgctcttctattttctagtttcttgatgtagaaactttgatttttgatttgagactagtccttgtcagcaatgtaagcacttcatgctatacatttttctctcagcattgctttagctgcatctcttgcatttttgtatgctccatatgtattttcattctagtctacattttttaaaatattttatatttgacataaactatttaagagtgtgtgtttaattttcatgtgtttagagattttcctgtggtcattctattattgatttctgcttcaatgtcattgttggcaggggacacattctgtctgatttcatttactttaaatttattgagatttattttatgaattagcatacagactatttcaattaatgttctgttgattgttgaaaaatgtgtattctgatattgtttggtgaggggttctataaatgtcagttagatcctactggttgagtgtgctgttcagattttctatatcctttgttattttctatctagtaattctctcagttgttaagtgggagatacagtttccaattatatttgtggatttgttttttacttttttcagttctagacatttttgcttcatgaattttgaagctttcttgtttactgaggacacaattgggattgttaggtcatcttgttaaatggatcttctgtcattattaaacttctttctgtctctaatagttttcttggattttatgtctactttattaggccgtatatattatatattaataaagtcacacatgcttttttatctttaatgttttaaatagcatttccttttccatcctttaactatcagcctacctatgttgttgaatgtgaagtgtatgtcttcacttttcttaggggaagagtctcaggtctactaagaacgactcttgagactgggtctcttttgttggttttgccaacctttactgggctatcccagtggagtaaggaaatatcaggcctaaatgggatggagagcacttcttctggtcactaactgatgccagaatttctgatcattcatttgccattggtattgcactcacctgatatcagagggtattcatttcaacatggtgaaaaaattagcctagataggatgcctacttttactaggtttcaggtcaagaaatgcctgcaaggcttcttctgttttgtgggtatatgcaagacatatactgctgatgccacattctcaaatccagggttccaaaccagttgtcagcattgtcttttgcttgcctcttgagtagtttatagagtttatagttgtgcttagcagggagaagcaagaagaaatagttctatatcatatccagactgaaaaagatgctgtttttggacatcttgaaaatagtaattttagagctatcaattttatcattatttttccttatgatttatacatttcaagtcttgttcaagaatctttccctacactgacgtcacatgatattacatattttctgtcaaaattcgtgcgtttttacctttagacattaagatctttaatctacctgatttaatttactctaaagaaataatctaattttgaaattttctcatagtctagtgaattttcctggtaccatataacatatgcttttcaaacacatttttttcatataggtttcaatgcatatgcaatgtatatgtgtttctaggctataattttatggtaatatatttatttatcaccctgataatatgacaatattttttataaccataataattcatttttaattgacacagtgagtcactacatatttctgaaaaattgccttaggttttaacactttacacttttataaaatcaccttgttcagtttcatccaaaactatgttgtgtatttgaatgaaattacatttactttacaggttaatttgggcagattttccaattttacaaatcttctcttccataaaatgtatttctccatttatttaaacattctattcctatagaattttaaaattttctctgtaaatgttttgcataattttgatataaatattcctttttctttcttttttttgggggggatggggaacagagtctcgctctgttgcctaggctagagtgcagtggcacgatattggctcactgcaacctccgccacccaggttcaagcaattctcctgcctcagccttccaattagctgggactacaggtgcacactgccacgcctggcaaatttttttgtattttagtagagacagggtttcaccgtgttgcccaggctggtcacaaactcctgacctcaggctgatagatatatttctaagcactgttatctcccatggcttttgcaaattatttattttttaagcttttattatctaattatttggcatatacgtgtatatatatacacatatatatacatatacgtatatatatacatatatatacatatacgtatatatatacgtatatatacatatacgtatatatatacatatatatacatatacgtatatatatacgtatatatacatatacgtatatatatacatatatatacatatacatatatatatgaaaggcatgttctttcagcaaataaagttactgaattctcataattatattaattccaattctcttataattatattaattccaatgctcttatattaattccaattctcttacaattacattaattccaattctcttataattatattaattccaaagaagattacttagatgttttctgaaatcgtttctatggtctgaatgtttgtattaccccgaaattcatgtgttgaaatctaatcacaatgtggtgatattccaaggtcgagcttttgggaagtgattaagtaatgaggaagaagccctcttgaatgggatgagtgcccttataaaagaggccccagagagccaccttaccttttccaccatttgaagaacagagaaaatgtggcctctatgaaccaggaaataagccctcactagacactgaatctgctgcttattttgaacttgatcttggactttccagctcgcagaacagtgagaaataaacttttattgtttataaagtatgtagtctaaggtattttgttatagcatcctgagtaaattaagaaatcaattataaaatgaaaaaaatgagactctttaaaatttttgtcagatgtacatttctaggaactttctggaggagaccttagggttttcaaggtaacgatcatattgttagcaaatagttacagtttgacttcctcaagaatctacaacgaactcaaacaaatcagtaagagaaaaacaatcccatcaaaaagtgtgctaaagacataaatagacaattctcaaaagaagatatacaaattgccaacaaacatatgaaaaaatgctcaacatcactaatgatcagggaaatgcaaatcaaaaccacaacgcaataccgccttgctcctgtaagaatgaccataatcaaaaaacaaaaaacagtagacagtggcatggatgtggtaaacaggcaacacttctacactgctggtgggaatgtaaactaatacagccactgtggaaaacagtgtggcgattccttaaagaactaaaagtagaactaccatttgatccaacaatcccactactgggtatctacccagaagaaaataagtcattattcaaaaaaaaaaatacatgtacacacatgcttatagtgacacaattcacaatagcaaaatcgtggaaccaactcaatcaacaagtggataaggaaactgtgatattatataatattatataatttatattatatgatagaatactatgcagccataaaaaggaatgaattaacagcatttgcagtgacctggatgggattggagactattactctaagttaagtaactcaagaatggaaaaccaaacatcatatgttctcactgacatgtgaaagctaagctatgaggacacaaaggcaagaatgatacaatggacttggggggaagagtggtgggggggcaagggaaaaaagactacaaatatggagcagtgtatactccttaggcgatgggtgcagcaaaatatcacaaatcaccactaaagaacttactcttgtaaccaaataccacctgtatgccaataacttatttaaaaaatcctaagggtgagaaaaaaagaacaaataattttattgtttctctgatctttattctttattttcctgaccatgtcccccaataagattttgagtagaaaatttgttgatcttaattttaaagggcctgcttttaagattgtatgatgaaacatgatatatttttgcaggttttcattagatagtcttatcaggtaaatgaatttctctttcatatctcctatatttgtaggttacaaggaatatatttttatgtttttattttctttttataattgtgtgtcaaaattgactagataaaccttgtgtatctacttataactttttaaaaatacgttacaagtttgtttaaattagttgacggtaagctatcccttaatttctgagaaaacatatattttatcagaatattttacttttgtgtatacattgctggtataggtttcaaatttttttaaaaaaatttttaatctttgaaaatgtcattaaccttcaatctttctcacactgacctaaacaagctttaatatgaaggttacgtaccagcaaaattaagtgttctagaaatttgtcattttttaatacattctggttaaaaaaaattagataagataaaaattatcttttatgtgagaatttgctaacatgtgccactaaaaatttttttagaacaacagtgggttttgtattagtgtgaatatttttgtgtgttaatgtgtgtgtctgtgtattgagtggatatgtccctgcaatatctgttgttagcaatcatttttcacttttatttttgtaccaaacattttgtcttgatcgaactaatcagtggttattatttattttgcttatttttatttttaattattttattgtttctcactgttattattattgtataatcctatatcactaataatttgatattactttatttcttattttgttacaagtattttgatgtataatatattgctttcatttttggtttcttgatttttcttttacattcttattcttatgcccctttttttctttctttcagtatattcagttgccttcctattattaaaccattgaattatacatgttacattaattttcaagcattcttattttcaaacattcttttttcatgatataaaatatagaatatatattttaatttatacactactttattcatacaacacaattgttgaatttaatacttttgttgtcattcagttctacatatttttaatttaagtttacattcacttcacttttgattgatagaatatttaaattgtttattattttaacataatccaaaaattattaaaaattgttttgtttctttttgtattgtttttacattgtaatttatttcttgatatttgtttcatattgtttctttagtaatttggagacttgctttgtttcctcctatttggatgaatgttccacgtgtattcttctacatctgttgggtacagacaaaagtccatcaaatcaagcttataaatgaagttgtctcacttatttttttctatggttttaaaaattgttctttctgtttaatctagcatttattgagaaataggcctactagtttggtaaatattttgaacctttgttgctataagcattaaagttcagaatcattttatattcacagtgaatttctccttccataatttagaaatgtccatttttatccttgacaatgacttcttctgcaaagtttgtcatctcagaaaattaatagaaatattactgtggcagaaataaagccaaaattgaaaatcacagtagtactctttgcaaagattttgagagaggaaatatgtcttaatatgcattggctttgattttaatctgtacactaggatagagtgtgggccttttaaactgcctaaagcaggaatttgaactggttccttccagaagtggcactggcataattcttattttaaaaaacaaacaagacaatacataaatataacttacctgaagaactataaacctagtaccctacttgcacaaggtgagaaatgaatattaacagcaaaaggtctattaaataaattaatgtaaaactactttgaccagatattgccacaactgcaactgaatgaaatttacacaggggagaaatgtgccaataaagatacactctttaagttatgcaacataagacaaaatttccatcatgaattcaaaacataagagaattagcatttccaagaccaataacagaatattaatcatcaagaacataaaaaatagtcttaaaaataagcaaatttataaaataacaaatcagaataaatataacaaatttggataacatgaagaaattaaaaagacattaaaaatcagtgaacaggtgaaaccattcttttgcacagattaaaagataattagtgaactactcaataattataaagaagcagagagggataaggtaatagaaaatcagagtgaattgttagaggcatggaaactgtagtgagatgtctaacaatacagaattagacaaagtggagagagctgactttaaataggtaattaaggtgattctagaattgatagaattcttgtctattcaagttcaagaagcacaacggctcccgtgtggaataaatccacatgtatacattcaacagggaaaaaaataaactcaaataaaacattttgaagcttctaaagaaaaaacgacaatagtacttttttaagagcaaggacaattggatttcctttgtcatctcaagtgctagaacagaaacacatatgataaagaacttcagtaatgaattcttagaactcaataataagaataacatgaagtctaacaacattcttaacgaatggacaagatatttaaacagccacttcactaaaataattatatgaatggtaaataagcatatgaataaatgctgactaccagcatgcaaattaaaatctcagctatatacccactagaagggtgacaacttaaaaatcttaaagtcagagatgggaatataatctcacacattcctggtgcaaatgcaaaatggtataaccactatgaaaaacaaaaatgtaagatttacagtaattttctcttttctaagtaaatgaggaaattgcatatttttatttagtactttccacatggcagccattgaaataagagatttacatgaaagaagtcaattattatatctcagtttcttaagtatcatcatcatcaactacttaaaatgagaaataaaaaactgaagctaaaataacttgtctaagccctcacagctagtaagtggttcatatatgatatgaatcttcctttttctctaaactgtggtgtagtataggttgctatatttaatcaaattcttgccagctgcatagattttcagtcttctaaggattcaaatgcaaaaaagaaaaaaactatactgcaaattgtacataatttattctttctctagaaacttgtaataatagatttttcctaaattatccaatgcaaaatagtagtttcagaggcagtcaataagtggtgtatgaaaaatatgtactgtggtcaaatacatttgggaaaagttaagataaaaagcataaaagttatttctttattggaaaatgtttaaaacttttattttgccaaataatatgtacatttctgaaacaatgtacagtagtaaacaatacctatatgtattttaatacagaaaacttttttcgtataataatttgcaggactaacttagagttaattagaatatcttcaacagtttgctctaaatcataattataataatgattaaagttgcactattaaggcttagattttaaaaggttatttaacaaaaaccaaaaatgtctagttccaaacatggagggtaatgcttaataagaatgagtatttaacaaataagtaaagctgtccatgaagaagaaattcttcaaaaagtaaacaaacaaaaaacattatttaagcatgatcctttgttgtgaagattaggctataatgggataatttgctatagataattctgaggaaatatattttattttttatttttgtttacaatatggaaagcaaatattacaaaaaataaagatgcctttaatctgagcatcatctaacaagatttaagataaagtataaatcataaaaagaaatgtctgtaattcaacaaatataaatatatgtattttttctacctttattataatgggcaattttctacttttataacatagaacacaaaatttggatcaatatttcaaaggttatttcttacttgttgtatatgtccactatgggttggtgggaagaccccatttataatggtttttcagtgactcagtatgacaaagacttcatttctacacaaataacatttctacaacaaggaaagaaaagttggaatttgacaccatcaatcaattcctttaactttcgattgacttatgagacttagtttaatttcatgggctaaaacaaatctagcattcttttctatcttaaagtggtagtaaattccaacctaataatttgcctgtaagaagaagaatcacagtatatgtggatagccctaataatcatgatcaatagttatttgaaactattttataaaagttttaatatgtcatttcaattttaactttttaaagaatttaataataaagtgatacatagatttttcaaaggttccactacagattggtttataagaagatgaaagagagatacaatatcttgaatttagtaagattagattttgagttcagtgtgaaggatatatttgaggaaatagatatataatgttgaaaactaatattaagtcacagtggagttatttggttactacttttaaatacttatcttacatgtatctctattttgcatccatagcatgtcaaatgtagttccaccctatttagggcaataggtaaaactaatgagagtatacaatggtggaatatcctcaatcatgttggagtgtattagtatataagaaacagaaagcaattcttagcccatgctggaagcctttatttaaggtgtgtaatctctttggcaaagcataactgaagttaaaaatttgtgtaaacaaggcattcaagaaaattacttttatttagcttagtcattaaagaatgagtgtgtatgtaatacatgcagagaaattttagaaggtaagaaatgtcctaacagaatataaacccttagagaccttgcaatgtattctacacagtgatgtagctgcagcaactataaaagttcctgtccaggtactttataaatgtatataggttgcactgataagtgaatgaaaaaaatagacaaaatattgaggacaaagttaagcaacgtttaatctttttaaatttttatggatgcataattttgcatacttatggagtatgtgcaatattttgatattatacaagcatagaatttgtaataatcaactcagggtaattggatatccatcacctgaagcagttatcatttctttgtgttaggaacattttaattccactcttttagttattttgaaatatacagtaagttattgttaatgatacttatcatatagtgctaccaaacactatatcttattccatctatctaattgtatttttgtacccattgatcatcctttcttaaagcctttttcaagtgcaccagggaggtttcattataggttagaactgtctgtttgctgcagttgttaaaaaataaaaatatcagccacggtttggatacttgacatttaggtttagtagtgtctaatcaaaaatttttggagagttacaataaaaccctgacaaaggtttaaaattactgtcttttttggtttggagataatatgagaaagacaactgacacatgcttgtgattctttatctagccattgcttactcactacagctatattattataacggtggtaggtaaattattttaattgtagtaaaaaagttaaagacaaaagtattaaaaataatgataactgaaatatgtttaaagacacaatacgactaggtataaattatgacaacaataatataatgtttatgagggtgttaaagtgtagagttttataagtgatagtgattgaatttaagttgttatcagcttaaaatataatgttataacatatgtgatgtagaccccaaggtcaccacacacattaaagaaaaaaatacatatacctatagaagttacaaaaaagtcaaaggaaggaatcaaagtttatcactgaaaacaaatcaacaaaacacacatgaagacagtggaaaaggaagaaacaaaaggactgcaagactaacaaaacaaatcacaaaatggcagtaggaaatcttcccttactaagttattttgaatgtaaatgaattaaactctaatcaaaacatacagagtgaccaaatgaatatttaaaatagacctatctaaatgctgtctacaaaaatctctctttagacacatgcaggctgaaggtaagtggatgaaaaaaagatactccatgcaaatgggaacaaaaagaaagcagggacagctatacttatatcagacaaaatagacttcaagtcaaaaacagaagcaaaatacaaaaaaggacagtgtataacgataaaagagttgccaggaaaatataacaattataaatatatgtgcacccaccatcatagcacctaagtatgttcagcaaacatcaataaacagagtcatgcaataagagtggaataattcaataccgcacactcaggaatgggtagtaaccacacaaaaaatcagtagatgacttgaacaacactatcaactaactggacctaacagatatatactaaatattctacctaagagcagcagaacacacattcttcaccagtgcacatagaatttttttcatgacaaattatgttaggttagaaaataagtcttaataattcattaagactgaaattataccaagtcttttctgatcacaatagaattttagaaagaaaactggaaattcccaaataggtagtaattgaacaacacactgtaacaaccactgggtaagagaaaaaagaaattagaaaaatgcttcaagaaaaacaaaaacacaacacagtaaaactaatgagatgcaccaactaagtattacaagaaagtttattgagataaatacctgcattaaaaaaaggaaatagatcaactagataatcaaattgcacatttcaaggaacaagaacaaaaaagaacaaacaaagcccaaagttagcataaggaagaaaataacaaagattcaaacagaaataagtaaaatagaaacgcaaaaggtagaaaaaaattaatgaaattgggtcttggctttttgaaaaaataaaggaaactggcacatacttagatttaaaaagatttgccaaataatttccatgaatttcatgtaattatctgttaatttttacagaaaaatctaaatttacggaaaaaaaattaacagataattacgtctacagggcataaacacaaatcagaatttcaccatctctaggaacacataagaaaacgatgaggatagttgtcacattgtctggcaaagctcagggaaagagtaaaatacaatcataaaactatcaaaaaaagatatccaggatagaaaatgggcaaaaaataaaaaagacaatttttaaagagagttaaaagggattaaggagaaaatgagacataaaaaaagagaagcaaaaaatagtcaaaagaaacacagaaaataaaatacaggtgaaagaaagaaaacattttatccattttttaaaaaaggctagtaagtgatatgcagaaaacagtagaagtgaaacatagataaggagagctaacatttgtataagtatattcccatggaataaaacagaaataataaaacaaaactaataggtttaaaaagtttatatagtaatcctcccttatgcaggttttcagttgcaaccacggtttgaacatattacatagaaagttccagaaataaacaaggtgtaagttttaaattacctactgttctgagtagcatgatgaaatcttccactgtcctgcaccatcctacccagagcataaatcatcccttagttcaaggtacctatgcctacctgcccattagtccctgagtggctgtctcagatcatctcagtggcagtcaaatcttatcagattgaccctggcatattacagtgcatgtgttcaagtaaatctcacttggtttaaaaatagtcccaaagcacaagagtagcgatgctggtaatttggctatgccaaaaggaagctgtaaagtgatttttaaagggaaaatgtcaaagttatctactttataagaaaaaaataaattgtatgtttaggttgctaagatttatgttaagaatgaatcttctatttggagatggtgaataaggaaaaaaataaatttgtactagttttcttaaactgcaaaagttatggctacagtacatgatagttaagatggaaaaggcatgtatatagggcttagtgctatctgcagtttaagcatctactgggggtcttggaaagtattccctgcagatgagatggaactactgtaatccaaaaaaagacttgaatctgcatcttgaaaagatggtgtcatgtcccagaggaaaaaaaatggtcccagactgtcaacactgaaggtatctcagtaagtttacttgatatcaaacatgaattcttattcagaaaatgctttagacagccaggccaaaaaaaaaaaaaaaaaagagagagagagagaagaaaagaaaaaatacaagttttttatattgaaattaacaagaggggaaaaagccaatcttggaattcttttgtagagcctttactgctagattaaaatggaaaaataccttcaaagtgctcaagggaaggaattatgaccaaaagaatttatattgagttaaataatcttttaagaataaaagcaataaaaggttttgaatacacaagaaatattttcatgaactgtttctgatctaagtagaaaaggtcaacacgagtcaatcaaaaatgactagaaaaaccgctagagtaggaaggaatttatacatttatctgtagatgtaagattcaaactaatgtgaggtttcgggtgaagaaatagaaggtatgtacttaatgcctaaatatagaaatgatataaacaccaaggtttgaggaaagagggtaagaaatcaggaagtatgtggaatactgacttttctaataattaccaatatccaaaaaagatggagttcatgaacatttctcaaatccataaatgtgagtaagataattttaaaaaagaaaacttttcagatattacaaaaccatcctaaatctttgctatatacgagataaacctgacgcaaagtgattcatataattttttaatgtgcagagatatagacaatttaaacataaagaagcagagtttactgtatcaataagaaacaagtatatatttaggccaaaactattaactgagacaaatcagagatctttataacattaatgggtaccaataacattgaagacaaaatagtaatggctatatatcacataagagcttcgatatacacagatacatttgtaggaaatacaaggaaaaatggaaacacattaatgaagaatatttaattttacttatctaggtcattgacagaatatttaaagacataaaatatatagttctagtaaatgatggagctagatttaaacttatcatcactggctctagaaactaagctttttaccagcatacaacagtgtgatactacagtgccccttggctgatgcaagtgaacataaatttatatatttggaggtgaaataaaaaatatctcctctgactaaaacaagaaacacatgaaaataaggggtcttggagatttaaaaaggaaagagaataaaataattttctccaaaagagactgtagtataaggacagttactgtgattggcaatagtgctaagagcctacttcagatcaattggggtgacaccagagtactagatgtctccaggaatccagcagaaagtgagtgtatccaggacccaacaagctcctcacattattactgcatctaccttacagctccataattatgggatacctcatcaacctccttcttgagcttccctctactctattgctctctttaaactgttttgccctgcctaatttgcacataagccattcatcgctatcgacttcctgtgttatgtgactccccagtataggcatccaaataaaactgattagagttttcatgatgctactccagattccagggcttagtttatgtcatgaggtcacatttatttcatgctgatctggtaggagacagggcaggattaggttataaaaactggctgcaattgaggactctcaaaagtctagtgtaggtgttgaccccattttacaaatatggtaatttaaatcattattaaagttaatttaaaaattatacccaaagtattaattgatatgtccatgtttcaatgatgccatcacaatatttttgtttaaatgcaccttgcaaaacaaaagctgatagcaaatgtctttttacccaaaacagttcattgaattttttatccataagaatgtaacagttataattttaaaaatccaacagaaatcatggttcgttgggggtaggcatgactgggaatgagagagttcatgtacttgagtgcatatgattctccttaggccaatatgttatagcactcttctactcctcctaggaattagcgatctagttaaactgaaacaaaaaagaaatggggggaggttccaccaaatattctcaagtataatgttatacttgtgcttttataattttagtctatgtatatttgtctaaaatacaaagaaaaataaaattttttttgttcaaaaagaatgattgtaaagccaattaaagaagctttctagacatctctgctactaatcccttatacttctaacataacagaaataacatggtacttaattttctttagaaaaatcaattcatatattaatagacacacagaaaaattgaatgatatcacttagaggatcacaagaaaaacatttcagacacaaggtatttatttctatttactgtaaaactgctttagtatgagatcccccatctaaaatcattttaattgaaccaagtaaaggctggccatattagcagcagggagagaccatgttgattttatggcatccatgagaacaaagataggagatggagcatttaattagaatgcaaaatccttttgctcctggtgcaaaaatgtacatggtcaaaaaccttataaaatggaaaaatattagtattctctcaacaaacaaagtagacactattttttctttacactttcctgaatatttcctactgagtttttctcaatagtatttttctgtaaacaaaatatctgttggatattgaacaataactaccaggtcagaatcaaaaggaaaaagtcatgagtatacttgtagatttagatggagtcgaaaatgtgacaatgaatgaaactgtccagatagagcaaatatagaaaaataaaagcaaacaatgacacttagagaaatgtatacttaagagttcaacgaaagaaaaatgccttggaaagacatgcatttatcatacttaaacaaatagaaagaaagtgttgtagtaaatcatatgtttgattgtctgatacagacaaaaaatgtggcagaaaaaaagccatttaaaagccaaataagttttgctttatacacaacttgacaatttcaaagtcaaatatgtataaaggcatcataccatgttaattaatcataagtaaataaataagtggaaaaattatcatgaagcataaacttgaaaaaagttcgtatgctttctgggaaatcagtaacttaaaacatgatagaaaccctatcaataagtagtctaacttataattagcctcagatgtctacatgatttggaaatatatacccatttttttcattagattaggaatctctaaagataaaaacttagaaaactaacttgagctttcacttagtaattaatggtagtaggaaaaattaaatgtagaaaatttttagaaatagaatcaaatgcatttaaaatgtaaaatctgttatgaataaaatattatggtaaagctaattatttgtagatttttgtctataatagtttattcaatcagaaaacatcacatttttaagagaaaataactttttcatgtaaaacaggaaacaaggaaaataataaataattttaactatattatatgtttatcatttatatttttactccgagatatgttaaacaagtaaggtaatttatatctaaaataagtaatctaatcttatcaggctagagtataacattatgcataaccttaatatactttcataacaaacttttaaaaatttgttttgtgtgctgtattcttagcttttaaaaatgacttttataaataccgacagagtaaattaatttgaacattagttggttttgaaacacacattcataatgtgaatagagattctaggaaaatgagtaccatcttcactctttgagagtgcacaatcacaaaaagtaacccccaaaacaaaccatatgtacatgaactagttaatggatgaagaaaatttggtatgtacaaagaatgggatgctattgggcaaagaaatgatgctacagtatgatgatcctaaaaacattatgctaagcaaaagaagcaagacacagaagactacatattgcatgattctatttatgtgaaacgtccaaaaaagcaaagatagagagaaaaaaaggagactagtggttgccttgggtgacaaatgagaggactataagtggacacgtggattctttctgggatgatgaaaatattctaaacctggattgcggtgatagttgtacacaatataaatttgccaaaagttgttgacttatatgcttaaagaattctatggtatataaattatacctcaacacagctatttaaaggaaggtgcattatatacacatttatacttttcagatattaataaaaaatggaaaactttgtttgttgcctcaccgaagagtaatttcatagcaaaacacaaatccccattcttagtttgccttaatttcaagtatcatatataatacacaatagtagatttaaaataatatgagaaattgttttatactggctgattatgttcacatatcattgaaaagaaaggatagttacaaataccatgtagttactacctgcaacatattttctaataatattatttaacatatgcatttaattatatagtctatacatccttccaagcctctaaaagtagctcctaaacaaccattaggctttgtcatcctataaatattcttataactgtaaaacatttggaagactgagtaactatttcaagtaaatctaaagctaaatataatgcaatacttaaaactttctacaaaatttaaggtccaatatatattcattcaagctttaaaatttcatacaatcttaggagtattctatattttttgttttcctcatcttatttcaaacaaaaaaaatcaagtgtattcataacttagaaatgatttcagtgacctatagcaaaaagactaagaactgcaataatggttttgacattaataatgttttggaggcataagtgttttgttcttttgtttcttttataattgttgttacttatactggagaaagaaaattgatcattttcttttctgacttgtctcttacattacagagcttgaaaagaccttaaggtaacatttcaacagcaacctcacaataacttgactattttatttgtttttcttacccaaagacagcagtactagataaaatgaagggaaattacaaggcatgtttacatacatatcgatgttttttttacatttatataataaaaaatgcattgctggatatattttagaagtatccttaataaacaaaagaaaatggtttgttactgaattttacctcatgaacatatagggtaaaattcctgtgtaagaacaatgcaagtatatacacatatgtccatgtctatatctatgttgggttgcctattaatgactggaactgcctgcccatgtttgagcttgagcctgagtctcactgtccctcttgtcagtccatccatctctttctgcccctgtatgcccgtttgtgcttttctacctgtctatccatccatctctctctgtggtatgtttcacactgtctttcagtttgcctgcccctgtcatggggtctgactattcctatcccatttttaatttctatctgttattctgtcaccacatgtgtttatcagcctgtctctgtttcggtacctgtaaggctgtatgtattggtctctaagtatgtatttatctgtttaagtgtctgtctatccatgactctatgtgtacatatgtgaagatttttcctttaatgtagatttagtgaatactatctttaaaaatcattattgtttcttaagagatgagtgtgtatagtattgtttgtgtgtgtatctatctcccaagcaactgccaactctataggtccaatctacataatggtaggacctagagattactcatgtttttcgaaagtcagcttctcttagcctatttaagaccatgctctattgcattctgcctctatattacaagatggctcctaatgaaacaaacaaacaaacaaacaaacaaacaaacaaacaaacttgtcacaggtagacgtggatatctacacctcaggcctctgctttctagttaccctcctcctaaagaggagctgtgaaggttttatgtgcaattgtagccccactctacatttccaaagaacctctacctcatggcctatgtgggcatttactaaaggtttaaagataactagaaggagttttaaaataaaaacaagacatgaaacaaatgctaaatacaactgatctcaaggtcaaaggagaacatataataactcaaatgctcagaaagttattttatgggcatttctccttttccaacttgattttcaagatccagcccaccccctgccgacccccattggaaacccatgaagagtataccttttttcaataatttgccatgttaatcttcatttctacatgtaaattctacctattctcataaagatatccattttccttgaatattcccaaccttgaacccacaatgataatcgaaaagaagaaagaaaaatccctggtagatcattttctgaagctcgaatcattctgggaggaacaatactatgtagagggagggtgtcagagagctacgagatgaaccacaggggtgtttaatgttacaaatcctatacacttcagggtctatttgtgatgggataagaagatgcttctcaatattcttcctgtagactaaaaatctgcttttcaatctcctgcgagtaaggcttggaaaaaatacaaacacacatgacaccaatgtgtatataaacactctcacatatacacatttacatccctactcatatgaacataaaatctttctagagatagtaaatctaaagacatattaaataaaaataatttcaatgcaatgtaatgtacgtagttatccaggtgtccaaataaaaatagctaaagaaattttgctttggtattgttctcctgtgtccaggagtctactaaagactaagatgatagggcctaataaaagaattttctaaataataacaatgttgtattaaggttctacataggcacaagcatatattttacttgcatgatagatattataattaaaacctggaattattaagcctgtttatttacattgcttgacttgggcaggtgattgacaacctttctctttatgatgattatatttcttgtattgtatatgggaatctgacaatatcacaaagattctgttgtgaaaatgaggtgatagaagaataatttatgaagtagatcaactgtacttaacattgcatgggggtgctggcctacttttcaaggatgttctaacaaattcaaatttggcaataaaatataactcagttctacaaaaaatactgtaggcacatcagatgcatcactgaacttaaaaaggaaaacccaggaatttacacaacatcatatacttcttcgaaacaaagcagaattaccacctggcaaagatttccctcaagcatgtcccgccacaaaaccattcaagtctactccctgtgtattagaatatttataactatttgtcagtttggcttattcattatttctctacataatatgaattattaaactaagcatggacttatttacttgcaaaattaagcacaaaatttttgtaactttcaaattataccattttgttctttagattttctataagtctgacgtatttatccatactcattcagcaaaatattttgaagaaaaaaagtcctaaaaagataagtcacatactctatgagaaaagacaaacagaaatcacataattaactagagtagcatcatacctgcgatttacctaaacctgtaaataagattaaaataagcaccatattatctctcctctttttcacttacagtgctatgtaatagatatttttctacatttttatagcttttctcatagtaaatataaaaccgtgccatggtttgagagccattatagtatggtgattaaatgtgatattgtgggacaaagattctgacccaaaccttagctaaccacgtaatctacttatgctacgtaatcatggacagttgcttcatctttcttgatttccacattagtaaaatgatcataatagcaagtactctggaaggttgctagtagaatggacatgagaaaacacatgtttagtaatagtctttactccacagaatgtattcaacataaaaatgttatgattttttttcatatatcgttttaacactgaagcttttaagtgtccattaacagtgaacttaaaatattgaggtagacatttacatcaaattgagattgtcggatgtacattggtagaagaaattggtctagttacattttttaggctaaaaataactgctgacatttgtatattagactatcttgtgccataaaacggaagtttagaaaatttaggaaacaccttaccaaagtaggaaatttgatcaaactttgaaaggctttgaaagtccttggatatcctaggagaggataaattatgttccttggccaaatttggcctaagaataatttttaaatttttaacagtgaaagagagggaggagaaagagaacacagaataatatgcaacagaatcttatgtggcctacaaagtcaaaacatttattgtattactttgctaggacggccataacaatgtactacagactgggtggcttaaataacagaagtttattttcttacaattgaaaggttgcaagtctgaaatgaaggtgtcagcagggttgtatgcttctgaggcctcacttcttggcttgtagatgtccgtcttctccctgtgtcttcacacagtctttcctctgtgtaagtctgtgtccaaattccctcttcttaggataccagtcctattggatgagggcctactctaatgactccatttcaatttaattccctcattaatgaacccatctacaaatatagtcacattctgagatattggaggttaagtcttcaatatatgaaatttagggagacgcaattcaaaccacattttctgtctgtttttttgtttgtttgttttgtttgtttttacaaaaagtagttagcagcctgtgttctggaagcctgagaagggtacacctgacaagggaaccagtagtttcctagtgcctcctttactatttgtctgacattatatataaattgagagaatcactcaatttagagatttgctttcccattaccaatttgtttggcttattttacttagcataatgtcctccaggttcacccatattgtcataaatgaccaaatttctttcttttttaatgctgaatagtatttcattgtgtatatataccagattttctttatccattcattcaacgatggatacctaggttgcttccaaatcttaaaatttaaatatatctatctctatctgtctatatacttacagatctatctatagatagagatagatagatatagatatagatatagatatagatatagatatagatataggtccatctatagataggtagatagataatttgctgagggaaaaatgcctcagggaattagtggccaagccaaaccatttaattctaactttgggtcaaaggggcagggtttaatattatggaaatatttgcctggagttagccatggacagaagaagaaagtaggtgagcacaaatctgtgaccacaaaggaagtctgaaaatcaaagtaaataacagcaaactcaacatcggggtggacctggatgtggtgatgttatgacagaaacaacaataaccattaatattttttactgctttacaaggccatataatagtattttgtgacattttgtcatttgatccatatcaccaaatgaatatgatgattacctactgtctacttcccccaaccaccacacacacacacacacacacacacccctttacagattaggaaacacagctgaaattataacataggctttaatctccttaagcattgggtcaaaatatccaaaaataatacaagaacttcaataatctttttataaatgaagtcagatgcctaacatgtctcctcattggtgtgtaggcgggttgtaggtttaagactgggttggcactgtcaacagacactgtctctaaagaaaacaaaaacaaactcaaatggttcatcagcaagtacttgcttttgtgtccacattttgacctagctagaatatgctagatactttcctgtaaagcaccttcaaaacaattagttggtggctcccttttgtacacagataaattcaatataacacatgtctgcctttactttttgtgttaatatttggaaacgtacaaaattttgtttccaaaattttccaaatatcaatgtgtttccaaatatcaatacaaaaagtaaagacagacatgtgttatgttgaatttatttccccatataactcagaatcttaaggagtttttctgtatattttaaacttaatatgagatgcatctgaggaattcagatgtagaatttttcagtagtcttgagacccaataaaaacagtttctagcatagatactatttttgtaaagatttaaattcacagttaaggtcaacatctggctgaatttaacattcacatttgacagttttactctcattaaaaaatgtttagcattttttcaaagcagaagctgtcttttattttaataaaggtcttcatatatttgctttgttccttgagggatggattggtacgcttgaactactctgtgcagttagaatttaaggccatatcactagataatccacgtagcaaaataaaatgcaaatgaaaagggcaaagggcacggtataatgagcaagaggatttattgtcttgtcttctatttccatatcctttgggaaaatgtaaaagtgggaaatgaggaatagttctctctgctttctctggcaaattatggttgataatttagctattagataaccgtatagaatatgccaagtgatttcccaaactagtcacttttcaattttatctatgcgtaagtatccacaggttctttaattgcaaacagtactcacatgctcaatgcattatttttattactgaaactgcaaaatagacatgtgataatatacatttacacagccaaaacccccctccacacacacacacaaacacacacacaaacatcattaaagagtcaaattaatttcaactagaacatccttatgggaaaatatgtgagaaaatatatgcaaaaatatgtaccatttattgagcatatgcggtgcacaaactacgtatttattatttaattcatgtgatcccactcccaacaagaatctaaaatgtagataccactagtgccattatacatataatgagacagaggtgtatagagatcaattaaacaaactagcttaacggatttaaacttagtttgtcttatcaccaatcctattttctgtctactataacactttgacatgtgaaatatagttaaaggagaatttgaaaacaacttgatgaacagtctggaatcctctgtaaagataaattcaagtcattgactgaatataggatgtttcatacctataatgcacataagcagcaactaaagagtcaggcttcatttcctccctctgtgtgtaccaattagaggtcctgaaatattaataaactggctgatttaggagagaataccattacatttttttttgtcctacatgttgcttggaagcaacaaacatatcatgggcactcagtaaatgttatttaacgacaactaataaaatgaaattatggtaatatattttgtaatgaactcaccataagatgaggcaaagtaagttttagtactaaacctggaagttgagcagatttcaatggctgggtaggtgaatgaatcctatggggaggcaagagacactaacatgattgtggtagagaatgttaataagaggtcagatatataaaatttttattgcactttgacaattggagctgcccctcctgattttcatatatgttatattcatctaacattcaaaaggcaaattaaagaatatattgctaaacttctattctagctcctccatacccaaacatgaagtgactatttcattatccattggtatcatcattggtatgattttggaagaacatgaaatatgttccctgaaatgctttctttttttcctacttgtgcctcctttagcacattgtttgagattttcggaagagtcagttgtaatttttaaaaatagaaaagagagagagaggatgttaaatcactgtatcctctgaaagtcataagccatcgaattgtaaaactctaagacattcaggagtgtatgtagtttcagagagtgcacttctgtaggtttaaattagagctgtgagttattgggggagaaaccagactgggagcaatctcacttttttaatgctttaaagtgagtggagggaaaaggttccacaaaggagagaaagcttgccaaatggaggaatccgtagggaaattttaatttaaggccctgttcctcaattcctgtaaagttcatgaaaaaagaagtacttaaaagtctctttgaggactttatactcttttctcttttccatttttttgccttttacaatccctgtgaggaaaagagaaaatgcacttaaagttacgatttgggtgactcaatccttccctctttcctttgttctaatagtctttcaaatgctccaaagaaattagaatacacttaacaagtgctcttgtgaagcttagccaccacttcctctcttgagcctgtattaacccactgaagggaacacaaactctgtgttccagtccatacagcagcaggtacaccatgctccaggtcaaatatacaccatgctccaggtcaaatatacctgctattctaaccatttttatagtcatttttaacacagaaaaacagcaacaatatgatagatttcattgagcctattcacacaataataaaacattaaaaaaagctcaagagccctaatactacatgtttataagatcactgtgattactatatgcttcttttctattctacactcccattctctctctgatacagaacatacacacacacacctttaacttttcagaaacagacacggaagtcacctttgctgttctaagatatcataagtataatgggataaatttcagtttcgaataaggctttctcccattttatcggttctgttgatattcagaagtttttcagtttttagcattttgctttgctaaacatttcttgtacttctatgaaaggcattgaggttttcactaacagaacaaagttaaataataattttgtagcataattaactgaaactgtagcaatcaattttagtaaaatcctttcaaactcaaaaatagatatctgtaaggcaaacaattatatctacataatattatcaaaaagacttatactgaagtttctttaaattaaatactttcatcattcaaatatttatgtatcatacgcatccatgataccaaaataaatacaagcatttgagacaaagtttgtattttggaaaatataaataaaatactatgattgttttaaaagattcaaaaatacatatgggtaagtgagtttccaaagtacatatttttcttcattatatattgcagctacaaaaggaaaatcctcaagagaattaatatgaacttatgataatgcagcctgcagcacggttttgttgtgattttttctgtttttgctgacaatgcaattcaaactatattctactaatcttcagtaaagggagcagattatttcacctataaacatgcagcaataaagtgtcattcttcagtccatacagactacttaacatctttctctttttacaggtttggatccctagctcattagactattacctgataaagaagagagggtaatgaattgagaaaataactacgtaccttcagagaaaacctgcccgataacaataatccattagaaaactggcaatatcctctgatctattgcccgcaaagccatgacttgatggagagtttcattccctgggctcagttctccagaagaaaatcagcacaatttaaatatttcttggaatgtgacagctctctagatcccgggttgcattctgttccccagggatggcaatctggtgttcctgtgtgcatagagcagtgaagat

SEQ ID NO: 399 - DNA, 345184 bp, Homo sapiens
tatcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggtaagcaaagccgcgccgcaccgggagcgtggctgtgggtgatgggtgggtcagggacccgggcaggatgtgcggtgtccggaggcatccgggctcagcattgttttctcccacctccttcaacgccaaaccttccttccttatccggaggttcccagactcagctgtcagccacgagacgcacaagtgactttttctccccactgacggcagaggaaaagttccgctctgcgtctttgcgttctgatggatgctttccctcattttctctgcaagcttcactaaaccgttgatggagggaggaagggagaactctggataaatgcagacccaccggatggttgtgcattgctttccaatgaagggttagcttttcccatacaatgaagaaaatgcacagcttactctcaagtgtaaaaaaagaatccctctagacttaaatgatcccgaaatcccaagatgtgtgaactttcccggtagggaggcagagttttaagtggaccctgcatcacagtaaagagcaatgcaagagcccagagtttttgcgctgcagaaagcacaaccggaaagcaatcaatcccccaagcattatcactggtccttgtggttaccaccacatccagggaaaacgcttcctgacccgctaatcacctcacagaatttctctccatccatttggcaaggaatttgtaaacctctttcctcccctttctctttccatcttccttccacttggggcttgtttcttctgttcgagatttcctcttttgggagcatgactttggggtaaggttatttaggaaagaaccctcgcacaggctctggaaaagggcctcagtgtaaatgcatgtgagtaatcaatcaaatgtatgtcagattaaaattgattttggtggagcagtcagtataaaacgatatgtatgtatgtatatatgtaagtatatatgtgtgtgtgtacatacacacacacacatccctcaatgacaatgaaagatggacttttacttactattgaatttattgggttcactaatatattcaaaagctctgttcagggttaagctgcgtaaccagtgcatcacgcatgttgcaagctcccagcaccagcttaggtagactaaccacagaatgtggctccagtaaagtctttttcccaacactgacacatggaagtttaaaatcagtggagaggtttctataatatataaagaagagtgggtggtaattacaaatggcttgtagtagtttctgttattttgtggctttttgattatgtaacaggagtgttctattctgggtgtgaatttggacaaagggaaattactattttgtttttaacccacaggtcagaaagcacactgttttcaaacttaaaaaacatcacaattaggaaacacatacattttggattctactgtattgatactacatggtgtcctgtgtgtgtaaaacaggcactgcaagagactttaaaatatatgacaataaagagcaaacggctctataatgttgtaaaaaacaaaagtaatggagtataaggaatatacaaattcttgcaactgagtttgccacttgtgaattgtactatgctggtttatattctcagaagggtcattgctgagtaatggtgcctcttttgttttgaagtttctttttgtgacaaaaaaggagggagacaacagaatattaacttgatttttcccctatttaatagtaaatgcaattaacatttggtaaatggcctttaaaattaaagatattagaaaataaagtgaattattatgttaggtttttattggaaaagtagcacatacatataatttaaaaaatcaaatgttgcaaaggagtgtgaaggaaagaccctcagacactccacattcccacttatgtagtccaccctcatagatgttaacactttcttatgtatgcttccaaaatattccatgcatgtgtaagcagatatatctatatgtgtctatgatgaactatagcagctcctgatttctacaaaaaaatctggctagagttttacaagtctcatagttttaagcatttttgaagcctagagggggtaatctggtaggtctttggtgggcagcagtcattggggtctgttcccagaggccttaacgcccttctaaggagaaaaaaaggcaggtggtaagctctgttccactccgtctctgagatcaagaacctttctggtgacattcttgaatctgctgccctgtggtttgttccctttagcatagtaaaaatgagtttccaaaaaaagtttagatcatataagaaatacatagcacatgttctatattgagagaaaatgcatttttcacagttttgccaagagatttttttttaaatttggcattgaaatgtacacaaagaagaaaagctttagtacattttaatcaaaatattaaatgctgttccaaatagctgtagtgcagtaataattgatattcataatgctgagccactgaaaggttgtgaatcatcaaatattaaattcttgtcagctcaatttaaggtattgtttcagaatagtgctatcctgacagaaaacagactgtcttgtatattaataaaaagaatgtttttagtaaatttgccctccataatttgtgaaaacatgtgtttagttgaaaaaacaattttcttctgagctgaggaaaacaatgacaacatttatctgtatgcatcttcagaaattctttctactgacattgtgtttcttccccacatataaccaatcctaggtttaaaaacgttcaatgtgagaattaaactaagtttttttaaaatctgtctactttttcctatatttttctgtgtgattgtttcaacagcattgacattgataaatgctgcatgttttttggtaagcgcattgttatataccacaataatgcaatagaatccattttaatttcttcttgatgacttgtggtttgaaatgacaagttggatacctgcagtattgataatctctaaaagttgtttactattctgcatttgaatatatttctaattaagaaataagaccatttatttatctggtatttgatatcaaacttatagcatttaaaatatttaacattttagattattgcttatagccctataatctgctgccctgtggtttgttccctttagcatagtaaaaatgagtttccaaaaaaagtctagatcatataagaaatacatagcaaatgttttatattgagagaaaatgcatttttcacagttttgccaagagtttttttaaatttggcattgaaatgtacacaaagaagaaaagctttagtacattttatattaatcaaaacattaaatgctgttccaaatagctgtagtgcagtaataattgtaatgttttggaaataggaagcagcatagcttatttactatattagttggtggaaactgagctacatgtgtattttaaaaatagcagttgatttttcttccattgtatgtgacacattgacgggttctactttttttcaacttccttttgttctacttaagaacaaattctctaggcaaggaagaatagaaattgtcacttggatctcatggacatgggtgtgggggatgaagatgggagttgggaatgaggtgttgagaccagcactggagcagctacttgggtgttgttcatgtctcattattttatatcatggcgagtctcactctctcatgtcatcttgggctggtatggtggatttttgaactgaagccttaaaggtgccccttgggtaccagtagacccctatcaagattatggctttcctcagagaggcaagaggaatgcagttcacattaagtgcctactactgtgagtcatatactaaactaggagctttcgtacgtttgtatcacttaaacctcacaggaaactctctaaagtatggaaggaaggcacagagagctactgttaaaatgtggagtgatgactgaaagtcatgtctgcttaatttcagagtttgtgctcttgggctggttctcagatgcaagaagtcccacaatccatcaacacttctaggtttgaaacagcccgaacacgtgagatagtgacagaagagtacgcatcttaggtcctatggtttgtggggtacattatcttttctcagccttctttccttcagttcagaacatttggaggttgattattctagaaagggattgcaacctcttctgtctttggctattttgttaggcctgtgctgtacttgaaaagacagagcaatctggcaggtgttctgcttggcgtcaatatatggagcttacatcctattgttttaccccaggcccactttccccatacccctgcagacagtggagtttgtgaagcattgtattctcttttaggctgatacgcaggcagaaaaaatacctgggtcataggaatatatataaatctaggggagtaaggaaatgggggaatcttcttttggagctctgaaagtgtgtgtgtgtgtgtgtgtgtgtgtgtgtgtttaaatagggacggttatgaagggaaattaaatgtgattaaaaattagttaaaaattttaggcactctatggattatataggcgtttgtagattgacccaggaattaatcagcatttatagattttattctctacaaatatgtgttaaaagttccgaataaccaacttatggatggattttggagaaataaccagaggagctggccagcctttactttaccgtaagggttgctgagagtgtgccctgggggcttcagctgcggctctcctcccgagatgtgatttggctgcatgaatggcatgaacctcttaggtagatttggtttatgatccccacaacttcagttagaatgttactttctctcaaattgccatagtaacatggtcacatttcaccttagaagtggttgcttcttattgcagggtctttctgatgtgatttcttatagcacctctcaagaaaatgaagaataaacttcaggtaaagagctttgtcttactttgatgaaaggtttttgaagtgtctgttgattagtgtttgctactattatcagaatttacaaagtttgttttcccttttggaaaatatattaaggctaaaaaaagtgtaagttaattacatagccattgaggggttaaacgtgcattgtgattgagactgaatagtgttttcccaacctttccctttttacaatggagaaaacaggtaattaaattttgtacagtaaaatgtcaattgaacatttattgccaaataacacctcaggcatagcagggcattatgaaaagatatcaggagacagccgaccttaccttggtgctactgaacaagcaattcattaactgcttctaggcaatgccacagcaaactaatcaggcagtggcccaggcagtaactcaatgaaggaattgcatcagtcttctttgcgccctcactcaattctgttcagctttaataactgtgaatattaaaaataactccacattcaggagcaatgtccaaactgagatgtgcttaacactgtatattttaaaaaactatccgactttagatgaccagacagagctaagaggcaggatctcagcaacagtaaatgagccattggttataagaaggagggagagaatcattgtgttggactttacattgaaatctaaggtaataaatcaataaactttattatagtgaaacctttcagttctgcaaaatcttagtgttttaataatgtaaaagaggtttatttgtagttttgttgactcttattcacctccctatctatcctagatcatctctgtattctagttcctgtaataggaaacaatagacagagtttatggtaattaatgattatactaaactgacaataactattagggccaaacggccaacttctgtaacaacaacattcggtcttacatattggcaaatgtattgtgtatttcagctaacttttaatggcaacaaaatcatagtatgacgaagtattggaatagtccattggatttaaaattggatttcatttgtagttttatctgtaacatcttttgtgaatataagagagagatataacctagtttattttcagcagtgccgtttaaactcatcttattaataatcaatctagcattactttgagaaaagtaggattgtacatggtgagtagaaaagaagcattgtttacattatcattatcacttcagaaagaaggcaagttaattttgaaaataataaaatctatcaaggcaaaacaacataaactattttagtgtgtctcgtttccatatatttcttaatttgtatttgtaaatttatgaaagtgtgtagctattataggcaaggttattgtgtttttccttaactatacatcttcatattcaaaagtttaaaatacctttgaaagataatatctgctttattaattcttatgctgacctttttcaagagcctttaatttttaacattttttacttcttttctcttgacttttaggttcagggggtgtacatgtgtaagtttgttccttgggtaaattgcatgttgctgaggtttggtgtatgaatgatcctgtgagctagtaagcatagtacccaatagttagtttttcaacccaagtaccctaacccaaccttccccttcgagtagtccccagtatttattgttcctctctttgtgttcatgtgtatttagtgtttagctaccacttacaagtgagaacatgtggtatttggttttctatttctgcattagttcacttaggataatggcctccagctgcatccatgttgctgcaaagcacatgattttgttccttcttatggctgtgtagtattccatagtgtatgcttcccacattttctttgtccagtccaccattggtgagatgattccatgtttttgctattgtgaagagtgctgtgatgaacatacaagtgcatgtgtctttttggtagagcgctgttggatatatacccagttgtgggattggttagtcaaatggtagttctgttttagtctctttgatgaatctccacactgctttccacagtgactgaactaatttacattaccaccagcagtgtataagtgttccattttctccacaacttcaccaacatttgttgttttttgacttcttaataatagccattctggtgtgagttagtatctcattgtgattttgatttacatttttctaatgattagtaatgatgagcattttaaaatatatttgttggctgcatgcatgtctttcaaaagccttttaaagatgctaagtatgtactaaacacagactaagcccaggcaatatgtataagcaggcaaacttgtattatttacacggtacaatatcacggttagaaatggtgggattgtgatgctactgagtatttagcaatcagagatactcaaattcagaacacctgctctgtgagacattctctgatgtgagggagatggatgcacaaatgaggcaaaaagagacaaaagaacactttagtgttatctgggaccaaaattacaatgtagaaccctagaaagctagacctgaccatgttgtaggcacttttccctaaggcccaaacgacttcaaacaaaagcaagccaaataacctgtatacttaaagcccacaccccacctcccagatctgacagccgatgatgagggtgcgcacaccttctagggtgtaatcaggggcacacgcattagggctagacaataaggagtcagagacatggtcagcagggggagagtatgtttcccctctaagcctcccttggctcaggctgggttaaggcctggttcaggaaaagggtaatggcatcagaagagtgatggccctgctcccctacaggtcagccctgattgttgggttggggaggagagagagaagaccatgctatgtgcactctgacctctctctcctttgaaagcttcctccccatataacataccccatcaatgtccttgaacttgcagtttcttaatcattgatggtgactaatgtttggaagtgggagtggggatggaggtgagggagttggagcctcatgctccccctagaggcgtatataaaagatgcaaagtcatcttcagcatttagtaaactccagctttgaaatattttggaagtattgatttcatatcataattaaatattatatatttagaaatgttattaatagtaagtagctttatttttatgtttaatctaatatataaaacacctagtaacatcttgaattggttttcctactgagcaattttctttataataatagcaaatactaatataatttgtatgatgagtctagcattgttttgagcattaacgtgtgtcaaataatttaattctcacaataaccatatgatatgcatattattattatctcgatttttacagatggagagatgttaagtgacttgcctaaggtcacatagctaataaacgcagagccaagaagtaggtccaaataatctagctccagaggttgcttttaatctttatgctatatgttcttatcctctaaaacagtattgatttgaagcttagctggtgtggataaaatagcagattttttattgttatcttaaacactaagttcagctgacaaatcaaaaaccaatttttaaaacagttttgggaaactcaaggattacttgaatatacattttttctcagtttcatagccttcctttcacataaaatacctataactttactttaatattgcattccattttcccttgagaggagtggggctcctagtagtacaagcaaacttcacattatcacactttgctttgttgtactttgcagatattgcatttttttaaacaaatagaagatttgtggcaaccctgtgttaagcaagtctactggtggcatttcgtgtctcattttggcatcgtgtgctcactttgtgtctctgtgtcacattttggtaattcttacaagatttttaactttttcattgttattatatctattatggtgatctgtgatcagtaatctttgatgttactattgtaattgttttggagtgccatgaactatgcccatataatacagcgaacttaattgataaatgtgtgtgttctgactgctccactgacctgccgttgtcagtgtctttccctctccttgggcctcctactctttgagacacaacaatattgaaattagttcagttaataaccctataatggcctctaaatgttcaagtgaaagaaaaagtttcacatctctcactttaaatcagaagctagaaatgattaagcttagtaaggaaggcatgtctaaagctgagataggctgaaaggtaggccttttttgtcagttagccaagttgtgaatgtaaggaaaagtgcttgaaggaaattaaaagtgctactccaggaagcatatgaatgataagaaagcaaaaacagccttgttgctgatatgaagaaagttttagcgatctggatggaagatcaaaccagccataacatttccttaagccaaagtctaattcagagcaagatcctaactctcttcaattctgtgaaggctgataggggcgaggaagctgtggaagaaaagttggaagctagcagaggttggtttatgaggtttaaggaaggaagctatctctataatgtaaaattgcaaggtgaagcagcaagtgctgatgtagaagctacagcaagttctccaggaaatctagcagagattatcgatgaagccggctacactaaaaaacctcaaattagaagaaggtgtcatctaggacttttatagctacagcagtgaaatcaatgcctggcttcaaatcttcaaaggacaggctaactctcttgcctggggtaatgcatctggtaactttaagtggaagccaatgctcaattaccattctgaaaatcctagggtctttatgaattatgccaaatctactctgtgccctatgaatggaacaacaaagcctggatgacagcacatatgtttatagcatgatatactaaatattttaagcccactgttgaaacctactgctcagaaaaaaacattcctttcagaatattactgcttgtggacaatgcacctggtcacctaagagctctgatggaaatgtagaggagattaatgttttcatcctgttaacataagatccattctgcagcctatggatcaaggagaaattttgactttcaggtattattatttaagaaatacatttcataaggctatagttgctatagatagtgattcatctgttggatctgggcaatgtaaattgaaacctggaaaggattcaccattccaggtaccattaagaacattcatgattcatggaaggaggtaaaaatatcaacattagcaggaatttggaagaagttgattccaacctcatggatgactttgaaaggttcaggacttcggtgggggaagtcactgtagacggggtggaaatagcaagagaactagaattagaagtggagcctgaagatgtgactgaattgcttccatttcatgataaaaattgaatggatgaggagttgcttcttatgtatgagcaaagaaattggtttcttgagatggattttactccttgtgaagatgttctgagcattgaaatgacaacaaaagatttagaatattacataaacctatttgataaagcagcagcagggttcaagagagtgggctcctattttaaaagaggttagttgtgagtaaaatgctatcaaacagcattgtatgctacagatacatttttcactaaagagtcaataaatgtggcaaacttcacttttatcttattttaagaaattgccacagccacccaaaccttcagcaaccaccaccctgatcagtcaccagtgttcaaaatggaggcaaggccctccagcagcaaaaagattatgactggctgaaggctcataatcattatgattatggctaatgatcattagcattttttagcaataaggtattttaagattaaggttatatacattgtgcttttagatgtaatgctatagcacatttaatagactactgtatagtgtaaacataacttttatatgcatgggaaacaaaaaaatttgtgtgacttgctttattgcaatatttgcttaattgtgatggtccagaattgaatttacaatatctctgaggtatgcctgtttatttttattctttgactgaagttatcttctttaccatgaagcaagagtttatggtccaactttggtataaattatataggctaaggatggaccattacttaattattgtaatctgttatgaattattttatattttgatagatttgtctcccagtgtcaataaataaataaataaataaaataaagagcatttaagtttccagtccaaggaagttgtaacttttgtttagtggtaggagagatgatgctatatggtcaagatttcctcctaattagctttgaggcagatatagtgccttacatgtaggaggaacatgtttaatatttgttaaattccattaaactgaaattctgtctgatcaattaatttcttatttttggtagaaattgcaaagtcaatatgtgggaaattcaaatatatgattgtgtcatgaaattgtgcccttgtggatgctttattgtgttaaaggtaatgaatccattctgctgtgcagagatttagtgtcatggccaaatggtacccataagtttgtccccataacttggagactgcctagtgttaaaggtacagtaagctttcttttgtatgtcagttttaattatctatctgaagttatgttaaattattgaaaggtacaggtctttggctctctctctagtattacagcacttatgcaataaagtatttggtcacattctcttaaagtgattttttttttcttgtccaaaaagaaagggttctcccaagcatttgaaacctaaaaaactttttttcctcatactttctcatgtttatttagtgtgggaacaagctagttttgtgataaatgaactgatgtttctatgtgcgtgtgcgtgtgcacgtgtgtgtgtgtgtgtatacttacgccaggcatattggaagtcagaagtctcaacaggaggtaacatttattttattttttttagtagagatgggggttttgctgtgtttcccaggctagatttgaactcctgggcttaagggatcctctcacctcaaactcccaagtagctggaactataggcctgtgtccccatgcctggtttaggtaaccttttgatccccagttttctttcctgcaactgggaagatggtctttatccagagacatcgtcatcaaagtaagaactgcataggttgtgagaagtcacactcagaaatgttagctgttaagcttgaccagtagttgaggtttctgaaaggagtgaagagaaagagagggatcaagatgtgctagaggggaatggagtcagatgggaccatgcttataaatgggctgagtaaatgccttgacaaatgtctttacttgaatcattctgccagaagttgtacattttggaatttatttattttttttaattttgatggtctttggtttttttggagaacttttaaccgatgggcacctgacaccttaacacacttagcagtgatcgttggacccaaagctcttttgagtctgaagattcctgagaagaatcaagggaggactgttctgggttgtcgatagtgatgattggcgttaaaagtaagctttgtctacttggctattttgctaaccccagctctaggaaagtccagggagattcttcatggtggcaccttcagtatgatagatttaccaatagggagaaatgacctgacaaacaaatcattgtagaagttggtgtactaggatggaagtagttgtgagtgctggaattagccaccactcctttaaaaaaggctctaaatattcacatactcaggcaaccatgaccgtcccttccttactaagaagctggcttcactacctccactaccttcactatttcttttgcccaaacccttttccccaggctgagtaagggaatgactggaagggacaaagtagacttggaggttggggcggggggtgtttgtggttcctgaagacagcctattccttccacttacctcattgtaaggtgaagagataatgaccctttctgaggttgagaaaggactcaagtgatgattcttttttgtttgcttgttttgagatggtgtctcactatattgcccaggttgaacttgaacttctggcttcaaacaatcctcctgattcagccttctcagtagctgggactacagcacatgccactgcacctggccaagagataactcttaagtgtaagattggactggtaatggtggcggcatttaactgtctccttctccaccaaatctccccataagttcagactggtgtctttctgtctcttcttgaaagacactgagttactggaccatcagagcccctgatgctctcctgtttgtggagaaagaggacactgtagaagacatccagtcctcttgctgctgccccacccaaagaggtttcttgggtgaagagactctggtaacaaaaggctgggacaggggctggtgagggatgggagggaaaaggtcaatgttcatgccaaatctcccacaccaggataataaatgtgtggggaagaagggcactatagggaataagcaacttcatagagagtcagcctttggatgcctgcctcacagagagaaccagtggtcagttcagtgttaatttgaggagtagagaaaaccaacccagtggggcctgcaacatccctatgaggccatcctatggagagacctcggcttcatttcatcctccagcttaagactagaaaggaagtgtagcagggaagagaaagggagaagtgggtagagtagacccacccccagccctagccactaaatccaccattctagcttgccgtgggggctgcaaagtagagaagaccttgaattaaacatgacattgaaattttaaagtgagcaagactgagtaaggactcaaaagaacccttctgataatggaaacagaatgaaacactatggaatctgagtaagctatcagtaataactggagtatagagaaacagagaggatctgagaatgagcagttagggaaaaaaatatatgtttataccacaacttgagactgcttacttattcaattacattgttatagaattggagggctgaatgggagcttagagaccattttccaattctaccctttcattttactaagccggctgtctactatcactcccattctttcagagaatcattaaaatgagattatttgtgataattagataatgtaattagaattgtttatgataccagggataggtagtggaggtttctttcaagcgttcatgttatagaataataatgagcacaccattgtcaagatcttacaatatcttcaattcttacaacagtctgggaagacatgtagctatcattatcacttccaccttagagatgaggaagccaaggctcactattatgcatgtgtgtgtgtgtgtgtgtgtgtgtgtgtgtgtgtgtatgtagtagggttgggggaaggtatacttttactcttcattttcttttgtcttccaaacctgcaacctgaaaaaacgaacaatgatttcagaatatattcatctggctggaatggagctgagcagaaaaacaaaagttaaggtagttaaaccctggattgttttgcaataaaagcaaccaccgtttattgagttaggtgcatatatgttatttcatttaagttggaagtaggaaggatctaagaaaaagcaatggatctgaagtagttgttttggcacaactcctagggctgggttttgggcttctgactcttcaaaacttacatgtcagcaaccccaagtattagtttcttgttgctgctgtaataagttgctacaaacttagtggcttaaaacagcacagatttattatcttatagttctagagtcatttattgtgttcctctgtgcattgtcagtgtaatggggtatgtatgccagcctgtatggcagtgtaagatattaaaataagaacaaagcccagttttcttagcactgcttgtatcaaagtgtgatttccatataagctcacatcatagggaatcagttgcaatctggtttcatggataacaagaccaggttatggaatatttttcattgcatgaagcctgttaaaagccagaagagaaaagcaatactttctgctgacattgggatcaactgagaatgtggtgggcttagtggtattaaataagataaaaagttgaaatcaaaatttaaaactgtctagatgtagatattagatatttatttacataaaatgaaaattctgaagtggatatttttgctgttctgaacttcttcaagaaaaatctggagaaagcaaaactgtgatttaagttctttacccactgtgcctaataccttactatcttttaaagaatttgcttttttacaagctacagaaacattgctctgaagcttcgtatggacattaaagcttaactgtgtttatctgattatgtttgaagcctttctgtattcttattaatggtttcaattttgatatttaggtcttacatttgaaaatggcttaagcattttaaagatcaagtagatgattaaggtagattatttgtcttgtccctgtaaggatcacggtgctataacccacaaggactgtctttgtagttttcttcaagttctcttttttccccctatcatttgggtcttttcctttataaaccattctgtttttcagtgttcaggaagtatatcactggtggtggtactcagccctccaaagtattgtttgctttagatagttggcttgatctacatctgaacttaaaatttcactataaaaatcttttttaaaggaggaatttagctgagaatatttatacatgaacttctgagcttttgaagtgaagaggtccactctccatatttataaatactttcatctgatgggaggctatgtcgctctgacaaagagatccctgcacatagtggctcaaacaagatagtttatttctttaataagcaacactaagcaggttattacaaatcaggtaggtgtctctgctccgtaaagtaattcagggatccagattttttgctcttctttttgggccaccccttaagatgttggcttgtccctttgatgaaaatggcctatcaccacatttgccttctatttcataagaagggggatgaggaaagtggagagcaattagtttctttttaaggaagtgacccataagtttcacatgccacttctgttcatatcccactggcccattggcccagtggtcatatggccatacccagctgcaaagaaggctggaaaatgtagtctttatcaggatggccatgtgcttaggtagagattaggagattctattggtaaaatgaacaagaggagactgtaagtttttgttaaggttaaaacagttagtcgtgggatatattcttaatttggagaagggaccaaagtgttttgtaataggagggaatcagacattattctgttttggggttcacattgtttaacctggttaggaaaattgaccagaacacggctcatgtgctactagggtctgtctgtatgagccagttggcttcaaaatgatgtctcacagacatggactgcactttttatcctgactttcaaatgtataccatatgtgaatcatagataaactccaagcaagaacaacttaggatgccttgagtaactgttgtgtgccacatgctgtctgaaagatcctgtggtgaacttttaggagagcctttggaggtcattttgcagttaaccacactagggcaggaacccttctagatgtgcagaatttgcttccagtcagcagggagttgcctcccttactagggagccaatttcattttcagtctgcttttgtcgtttgaaaaaattcttacgttgagcccaaatcaagttattctctgacactttccttaggcagtcctatttctaccttcaggagctataaagagtaagtttaagttctcacatgacagctcttgacatatttgaagggagttacgtgggtgtctcctcccacactcccactataataaataacccctgacatttattgggtgcttaccatgttccagacactgttctaagcactttatgtgtattaactcttaccaattcttactagtcttatgaagtagggactgtctaccccatttcatggatgaggaagttgcagcacagacaggttaagtatttgcccagattcacacagtaagtggcatgttctgatttgtcagtgtttcatttgaaatggtgttcctaggcctcaacactggttgctatgccagatgcactgtggtccactgtagtgggctgttttaccttccttcttttggatcctgtatttctacaaatgtaaccatcaggagaattgtttttctggaaaaaaatacatattccattgaccacagttcagcaaagttgtctttatattaagacactatgctcctgaatttgagaggatatgatgagttcaccaaaggtaggcttgatatggcagctggattcaatttaatatgatgtataaagccgttgtacttttcttcaatagggaagcaattataggtaaaaatcataggtaaaaaatcagttaaaaatgattttctatttttccttttaagagatgggctctccaggctggtcttgaactcctgggctcaagtgatcctcccatcttggcctcccaaagtggtgggattacaggcatgtaccactgcccccagcttaaagataattttcttaataactatgtgaaacagtagaaataaattagggattaggagaatggctagaagtttctagaattaagtgctagatctaagaggtggtatagcactaccattaaaaggccctagaattggactgccagaattggaatactgattgtctctctctatatatatatatgtggttggtggtttttgggaggatttaaatgagagaattcatgtagagtgcttacctaaatggttgatacaaggtagatagtcaatgaatgttaattattattatttggaaataggaaaataaaatctgaggctagttttgaaagaattgtcaggacttctcagatatgaagaaataaagaaatagtaattcttaagactttgatcatagagggctttgaataaaatggtatgtttgagtcatggagcaaaccttgtcttttggctgccatatctaaccaggttggagttgtgatggtcatctttctggtagatggggcagttccagtgtctctgttcatattggtcatcattgattttctctaatttcttgcagtattacaaagaaaaatgcccagaaactttgatttgagttgatatagtaagtagttacttgttttacgcttcaaatttcttccaaaaaagttctgtaaaccactcctcagtatgtataattgtcactctctctgttctttcttgacaaacaaaagcacaatttttacgaaagggtcaagtttgtttaaaagtggtctccactttcctcaaattctagagtaaaagaatgagctatatatgaatttagcatagctcaatttaattcagcaaatgatttttaagtacttacagaatttgacactatattgtgtccttggttttgatatatttgtgtccttggttttggtcattcttttatctaaaatttcatattaatgaacaatatataatggttttttttccttgcttcaagttgattgaaattttagaaaagtcctcataattctcatcttgacacaaactcagacttaagagacacctaaaactctgtgaaggcatctgttagaataactttcttaacttgtccaaactgattgcaccttacaattcaatgacatctttgaattttgctttttactgagcaaaagtcctgttacagctgatgacttcatactccttttttttttcaccctggaattatggccattttggtaaaatttgtgctatatgcaaaacgtgaatgaaaacttaagtatttaaaaaatcagtctgtaatccaaacactttggggagctgaggtgggagcatcactttagcccaggacctcaagagcagcctgggaaacatagtgagaccccatctgtacaaaaaatacaaaaattagccaggtgtggtggtgcatgcctatagctccatttactctggaggctgagatgggaggattgcttgagctcaggaggttgaggctgcagtgagctatgattgtgccactgcactccagcccgggcaacagagcgagaccctgtctcaaaaaaaaaaaaaaaaaaaaaacatgtctgactcctactcagatattcagcttgtttgtttatgagtctgtctttcttgttagactgtaaattccttaaaagccagaactctttcgagctgttcagttttgtggtccaaaacgatgctctgtaaaggcaggggccttaaataagtaatgactggtcttaaaataaaaccttaaaattaaggaaaggggtgaaccataaaattggcagctattactcattttattataagtaataatttggttaaggaagcaatattgccttttttttctgcaggttttttgaccaagcatgctgaaaatcagaggtgtctctggttttttgccttaggtgtttgtcacctgccaggttctcgtgggtaagacacaagtcagtgggtggaggaggatataatgaatataacatttttctgcttctttctttatacctattagatttaaacatagctttctttatgaaagcattctgaaagaattggaattttggctgtaatctttgtgcaagccaatcatggattcactctgaaattcagctgctgtatgacactggacccagtcctagtaccacagtaaaatggagccagtgttcctggaagttttaaggctacaagctctttcagtagaaggcataggcagtattcttttagctaatcagctataaccttgattttcacaaggatgatataagttagaaactatcctataaacagtgggaaattacagtgtctcctaccaattccatgaagaaagggaccacattttagacttttcttgcatcttctgtagctcctactaagtgctaagcatgtacttgatttatctcccatctctcacccaaactaaaccaagacaactcattctcttctaccttccttaagggaatcttgccctgagttaatgtagtctaccattgctaggttcgctttccttaacaggaacttaagtctttgagagacagcgtgggcaggtaagaggacacagatttgagaatttgatctgggatcctggaatctcatttttgctactttctaactgtgtgatcataaaatttttcctgagcctcagtttcttcattggtaaaatgggaattttaatgcctatcccacaagtttgccataaggcttgcaggtgaataatgcaatatatctgttatatattttagaaatattttaggctgtgcctaaaaaaatggacttgacaatccatttatctagcagttcctctaataaagacactgtccattggctactaatgaaaagtcggtaattcactacataattttacgacagggtctatatactttcctagcagttgtacctgccagtatttccttctcggaggcttttcactgagcctcacaacagcagtggactggtgtatgagaagcagtcctatcggctgccgctatctcttaatcaaaccatgtatgacatgtatttagtcagactacccatctgctatcttgagatacctcgttcacaatagcataagtgaatgtttgtgaatatggaccacatctggcatgggtggcctatcatctacctacgcttcatcctgtgagatacaactaaaatgaaaacaatgttctttaggtgattatatataaaggaatttcttaattctgatagattttgactctttccttcaaatattgaaaattgagttgatatataattgatttatatgtgaagatgaggaagaatgtggaccttttctcttactatttaatgttttatgttaaatctttaaatgtatgcttaatatctctgttgtggatccaaggccattgaaatttaactctactaacagcctttttggcaatgctaatcaattctttttacactataatacatttggcaaagttacttttaatgaccgattcgttcattcatctgttcattgatgcttctagcattcatgacaagactatatttgcaatatagagattcgaaggtgaggcagacatgcacaatacccaatgtattaaaactgtaagcccaaatagaatataggtgctgtaacagaagtatagtatagagctgagctccaagccaggtgcttaaaaatgtttattgaatgagtgaatatacctaggcctggatatctgtttgctggatatttccaagttcctagatttttccttctcgtttttcatctcatgaatagcaccactatcctcagttgcccttgctagcaatctggatgtcatctttgtctcctttttcccctcttctatcatatccaatgtatcaccatgttttcttgggtctacctactaaatagttctcactgctacactagttcaggccactagcttggcctgtatcattgtggcatcttcccacatggtagttctgcctccagccattttcttttgcctgattaattctccagagtagtagctagagtattatttctaaatggcaaatccaactgcatcattttcttccttaaaagtttttgatgacttctcattgtcctaggaataatgtgcaaatccctttacgtgggtcaggaggcccagtgcaatgtggagcccgctttttcttccagttccaattcctaccacttcctacttctcacattccagtttatgagatgacactgtgtgtatatatgcatataaatatatatgtgtatatatatatataggcatagtgccctgctcatagttgctcaatatatgttggctattcttatttttctaaatgtgctttcttcgaaactggcacagctgggaaaaatgtttttaggagcattaaacaagggagattggaagagagagaagctcagagtcgacaagaggatataatctaggtgttgtcaacaaagtggatatcatgataaaggttaaaaaataaatccattcaacttttgaaaaacgtatttttgggttggttttgaaaaataattcagtgtagcattaaaaaagtactctgttggatcttaaatttatcatttcctgagattatgatctagtttagaaaagttgccagatattcgctcttcaagatttacattgttttccaaagtcccccaaatggtcatagcactgttgttaagtgttcagttggctacagaatttccttaaattgtgatttttagtcaatggaatatgatgactcacagggaatgtaactgttttctgttttagcttactgatctttatcttaacatggtcaagagtctatgtttctattactctcacagattagcaaatatgttttttataagacatgaaataaaatatcattttgctaactttttattgtctagtattacaaatactgttgataacttgagattgaatcatttaggtcatgttttagagatgaatagaaaaaagtttgttattatagtttttctttttctttttataatttgggttggaagattcattttcattagtttggagtaaatagatcttttgtaaatatcagtatttcactggtgtttatattaattatgttttatttgataaaaccatttgcaagaggttggttggttcacgggataactgttgtcaaattgctttgaaatagtataaatgccacatagaaaacttatattattgagacgttttgatgatcaaaattacctttgagttcaaaacttgttttactaacagtaaaaagcacaaaacattttatttaatgtctttgtgattttaaattgtagtcaaagttttgattttttgctaattcatatatctatattagattacagaattgttatttaacataggatttaaaaattcttatgcttggattattataatttaacaatcaagtgtggcttttgaaaaaatattcaataatgctaattttgaagtttagaacaaatcttttaaaacttatacctttgcaatgtcaaaggaaattttgtaaaagtatccatatagtgatgtgaaatatgcttatgtgggcagaaacttgattgctgagatcaattttataattgtatacataaatccataatcgaatattccagtcattgccatttgggtaaaagcaaatactaaaagctgttatgtccccttaggaaacatatcaagaacagattgaaacagaatgtctttaactgtcttaaaacaattccataaatggttaccactttaactcaaaagttaggaatcctcttgaatccattgcagttctttacacaggctgccagctgattgtgtaattacatgccatatagcacaaagcatgatttatgacactattgttatggtgtgctcactaaaaataatgaaaaatagtaagtatagtattagcagagttgctgtaggtggttgccagacaaaatgcaaggcatgcagtcaaatttgcattccagataaacagtacataagtttttagtacaatttaggcaaaattatttattgtttatttaaaattcaaatttaagtgagcatcctgtgtttttatttgttaaatctggcaaccctagctgtatgtgattgggtagactataggtaatagtaaagaaacagatttttctaatgaaacagaatttcttccctaagttcctccagaatcaaataaagaatatcttggttacccagctagtaaatcatatttgaagctagtacgtgaacttagagagctagctttaagagccgtgccctatcaccacctctcatattggtgtttgtgaaattaaaagtaattcaattgcaacattacacactatttcatactgtattatgttgaatttatgcatcgttaaaattattaaaatccatttttaaattttatgttaagaaattaacttatttaataaattaattttcttctttttaaaagaggcatttttgatgagaattttcaaaaaacatgtagatttttgctgttctattataagtagtattcattagtttcaccaaatgtttttgtttgctttatgattaatagtgatttgcctttcattttcttgttaaggctgaattactgtgtttgtgctatgcaactgggaagcagccatagtttggagtggcacattgctctggttgtttctttagcttggctggccttggtctcttctgctgtagccatcagtcatccagtgctctttgcatgctatgggacatattttttcccatgagtgacagtggttgccttttatgacttagccctcattaataattaggcagggattacatatgaaatcttgtaataattcatgatctacatttactcatttacaagtataaataaatgaaatctaacagtcacaaaataccttgaaactggaacctcttaaatataaagatgaaaacatcacatcgtaagccccattagttaaaaatatgcttttgagaatggttaaaatgacttagctgaaaattccaaaaaccagaatgccccttctcctccaaaggatcacaactcctggccagcaagggaacaaaactggatggagaatgagtttgacgaattcacagaagtaagcttcagaaggtgggtaataacaaactccttcaagctaaaggagcatgttctaacccaatggaaggaagctaggaaccttgaaaaaaggttagagggattgctaactagaataaccagtttagagaagaacataaatgaactgatggagctgaaaaagacagcacgagaacttcgtgaaacatacaaaagtatcactagccgaatcgatcaagcagaagaaaggatatcagagattgcagatcgacttaactaaataaagtgtgaagacaaaattagagaaaaaagaatgaaaaggaatgaacaaagcctccaagaaatatgggactatgtgaaaaggccaaacctatatttgattggtgtacctgaaagagatggggaggatggaaccaagttggaaaacacttttcaggatattatccaggagaacttccccaacctagcaagacaggccaacattcaaattcatgaaatacagagaataccacaaagatacacctcgagaagagcaaccccaagacacataatcatcagattcaccaaggttgaaatgaaggaaaaaatgttaagggcagatagagagaaagatcgggttacccacaaagggaagcccatcagactaacagaggatctctctgcagaaaccatgcaagccagaagagagtgagggctgatattcaacattcttaaagaattttcaacccagaatttcatatccagccaaactaagcttcataaatgaaggagaaataaaatcctttacagacaagcaaatgctgagagactttgtcaccaccaggcctgccttactagagctcctgaaggaagcagtaaatacggaaaggaaaaaccagtaccagccactgcaaaaacatgccaagttgtaaagaccattgacactataaggaaactgcatcaactaatgggcaaaataaccagctagcatcataatgacaggatcaatttcacacaaaacaatattaactttaaatttaaatggcctaaataccccaattaaaagacacagattggcaaattggacccatcagtcaagacccatcagtgtgctgtattcaggagacccatctcacatgcaaagacgcacataagctcaaaataaagagatggaggaatatttaccaaccaaatggaaaggaaaaaaaaagcaggggtggcaatcctagtctctgataaaacagactttaaaccaacaaggatcaaaaaagacaaagaagggcattatataatggtaaagggatcaatgcaacaagaagagctaactatcctaaatatatatgcacccaatacaggagcacccagattcataaagcaggttcttagagacctacacagagacttagactcccacacaataatagtaggagactttaacaccccactgtccatattcaacagatcaacgagacagaaaattaacaaatatattcaggacttgaactcagctctggaccaagcagccctaatagacatctacagaactctccaccccaaatcaacagaatatacattcttctcagcaccacatagcacttattctaaatttgcccacataattggaaataaaactcctgagaaaatgctaaagaacggaaataataagaaacagtcacgcagaccacagtgcaatcaaattagaactcatgattaagaaactcagaaccgcactacatggaaactgaacaacctgaatgactactgggtaaataacaaaattaaggcagaaataaataagttctttgaaaccaatgagaacaaagacacaatgtaccagaatcgctgggacacagctaaagcagtgtttagagggaaacttatagcactaaatgctcacaggagaaagtggggaagatctaaaatcgacaccccagcatcacgattaaaagaactagagaagcaagatcaaacaaatttgaaaactagcagaagacaagaaaaactaagatcagagcagaactgaaggagatagagccacaaaaaacccttcaaaaaatcaatgaatccaagaactgtttttttgaaaagattaacaaaatagatagatggctagccagactaataaagaagaaaagagagaagaatcaaatagacacaataaaaaatggtaaaggggagatcaccaccgatcccacagaaatacgaactaccataagagaatactataaacacctctacgcaaataaactagaaattctagaagaaatacgtaaattcctgaacacatacacccttccaagactaaaccaggaagaagtcaaattcctgaatagaccaataagttctgaaattgaggcagtaattaataacctaccaaccaaaaaaagcctagcaccagacagattcacagccaaattctaccagagatacaaagaggagttggtaccattccttctgaaactattccaaacaatagaaaaagagggactcctccctaactcattttatgaggccagcaacatcctgataccaaaacctggcagagacaaaacaataaaagaaaatttcaggccagtatacctgatgaacatcaatgcgaaaatcctcaataaaatactggcaaaccaaatccagcagcacatcaaaaagcttatccaccacaatcaagtcagcttcatccttgggatgcaaggctggttcaacatacacaaatcaataaatgtaatccatcacataaacagaatcaatgacaaaaaacacatgattatctcaatagatgcagaaaaggccttcgataaaatttggccaggtgcggtggctcacgcctgtgatcccagcactttgggaggccaaggccggcagatcatgaggtcaggagtgaaaccttgtccttaataaggatacaaaaattagctaggcatggtgacatgtgcctggaatcccagctactcaggaggctgaggcagagaatcacttgagcccgggaggcagcttcaggctaaaaactctcaataaggtaggtattgatggaacatatctcaaaatagtacgagctatttatgacaaacccatagccaatatcatactgaatgggtaaaagctgtaagcattccatctgaaaatcggcacaagacaaggatgccctctctcaccactcctattcaacataggaagttctggccagggcaatcaggcaagagaaataaataaagatattcaaatagaaagacaggacatcaagttgtctctgtttgcagatggcatgattgtatatttagaaaaccccatcttctctgcccaggatctccttaacctgctaagcaacctcagcagtctacggatacaaaatcaatgtgcaaaaaatcacaagcattcccatacaccaataatagacaaacagagagccaaatcatgagtgaactcccattcacaactgctacaaaaagaataaaatacacaggaatacaacttacaagggatgtgaaggacctcttcaaggaggactacaaggaaataagagaggacacaaacaagtggaaaaacattccatgctcatggataggaagaatcaatatagtgaaaatggccatactgcccaaagtaatttatagattcagtgctattcctatcaagttaccattgactttcttcacagaattagaaaaaactggttcaaatttcatatggaaccaaaaaagagctggtatagccaagacaatccccagcaaaaagaacaaagctggaggcatcatgctacctgacttcaaactgtactacaaggccacagtaaccaaaacagcatggtactggtaccaaaacagatatatagatcagtggaacagaacagaggcctcagaaataatgccacacatctacagccatctgatctttgacaaacctgacaaaaacaagcagtggggtaagattccctatttaataaatggtgttgggaaaactggctcgccatatgcagaaaactgaaactggaccccttccttaaaccttatgcaaaatttaactcaagatggattaaagagttaaacataatacctaaaaccataaaaaacctaggcaataccatttaggacatgggcatgggcacagacttcatgactaaaacaccaaaacaatggcaacaaaagccaaaattgacaaatgggatctaattaaactaaagagcttctgcacatcaaaagaaactgtcatcagagtgaacaggcaacctacagaatgggagaaaatttttgccatgtagccatctgacaaagggctaatatccagaatctacaaagagcttaaacaaatttacaagaaaaaaacaaccccatcaaaaagtgggtgacagatatgaacagacacttctcaaaagaagacatttatgtggccaacaaacatacgaataaaagcctgtcatcactggtcattaaagaattgcaaatcaaaaccacaatgagataccatctcacgccagttagaatggcgatcattaaaaagtcaggaaacaacacatgctgcagaggatatggagaaataggaacgcttgtacactgttggtgggagtgtaaattagttcaaccattgtggaagacagtgtggcaattcctcaaggatctagagccagaaataccatttgacccagcaatcccattactgggtatatacccaaaggattgtaaatcattctactgtaaagacacatgcacacgtatgtttattgcagcactattcacaatagcaaagacgtggaactaacccaaatgtccatcaatgatagactggatcaagaaaatgtggcacatgtataccatggaatactatgtagccataaaaaaggatgagttcatgtcctttgtagagacatggatgaagctggaaaccatcattctcagcaaagtaatgcaggaacagaaaaccaaacaccacatggtctcactcataagtgtgagttgaacaatgagaacacatggacacagggaggggaacatcacacaatggtatgtcaggggtgggagcctaggagagggatagcattaggagaaatacctaatgtagatgacgggttgatgggtgctgcaaaccaccatggcatgtgtgtaactatgtaacaaactgcacattctgctcatgtatcctagaacataaagtataataaaaaaaccatagtgttaaaatgtgcataacagaaatttttaccattttaaccatttttaagtagatagttttgtgacatttagtatattcacattgttatattcccagtatacaggtccataacattttcgtcatcccaaactgaccctgccaattactcctcatattccacccctccccattcctggcaaccatcgttatactttctgtctctatgagtttgcaaaggccatgtttaatagtgccaaaacttgatatccactattaataggagcagcatgatatggtaggaaaaattttggactggagccaaacgctttctgtcatatttagtttgtaatctgggccaaactgtttgatttctctgagactctgtttcttcgcctctaaaatgggactagcaatttactgtgatgttgtgagaattacatgagacaacgtatgtaaatcatcaggctcataataggcatttaataaatgatattagaaatatagaatgttctcaaagtattcttattttattttatttttgttcttaaaatattaactcatttttttcagtcggacaattttttaatgacttctgcaggagccggtgagactactacagtgtaatgatagtatgtcattgtgaattcaaatctacctatttcccaggttggtccatggtatgttacaaatgaattttttttccttggagagtagaaatcacaagtcgttgcattttataaactgaagttttaaacaatgttttgctatatctatagaaataaatttttttggctgttgccagtagaaagcaaagtaatgatttaactcatgaattttatttttggccagtttttaaatcatcctctaattttcctattaaaattattttgtttgtaaaaaatccttacctttactttgggaggccgaggcgggcggatcacgaggtcaggagatccagaccatcccggctaaaacggtgaaaccccgtctctactaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatccttaccttttgttcaattcactgtctgtcacttccgtcttagaatatatagaataaataaaaggagatttaacttaagcttgctaaatttttgttagctctgttaaaacaggtcttctgtattccaggagtcaaagagtatttaaactacccaaataatcaagttatgcaaattaatgaaattcctatattgttaagttacatattttactatttccaatgtattgattgaaaaatatttactgggcaatttctctttttttagagatgggttctctgttgctcaggctggagtgcagtgacatgatcatggctcactgttgcctggactgcctaagcttaagggatcctcctacaggcacagtctaccacagatagcttatttttttaaagttgtttttgttgagatggaagtcttgctgtgttgcccgggctggtgttgaactcctaaactcaagtgatcctcctgccttggcctcccaaagtgctgggattataggtatgagccactgtgcctggctttattgagcagattctgtcaagtattaagtatcagtttttgtgagagattaaaaaaaatctaaatcatgatttcttccctgaaagaatttagagtctccttggaaagggaggccacttgtgcattaaagtttaaggttgcggttcagaaggtcagagtcatggggtttgtgagactaatgacgagttaggctttgaggtgaagatgggatatcctaatttaaatgagactctggatctcaggacaaaagactggcatgctatccaacataaagggttttatatgcattaatgataaaagcagatgttggtacaatttgtaaactttgctccctaaatagtaagtatattttaaatattctacaaaataatcaagtttgacaatagttttcagttgctacctctttctgtggtctctgtctgcttagccgttttcttgaaatcagtggcttcttaaaggaagaaggacatcaggagtatgttagaattgcgcctcaagatcagctgacttcaggtcatatatcttcaccactttctccagagaagatagatatcaaaaatccaacttggctaagctaaggatgggaactgaaggatgaaggatggagagccgggattgggccaggcctgtagaaaggcatctagttatgactggcgggtgacccactgaatcaactaagtgagtggattggtttcagtgcacaaagttagtgtgtaaaattgttaactaaaattaggtttctggaaaaattttgggattttattacaaaagctatgttaatccttaattatcataggaatcatttggtgcatattgaaagtagaagaagatatgcatccagttagaatattatgcaatttagcatcaccagggaagcgaaacagcagcatttgtttgaaattgggggctccttttttccaattacatttttcaaagattgctataaactgtgatttttttttcaaagaacaaatagtcattcctatattgaattcagctgtgtgtttaataatttttacattctaaaatttgtatgtggtgtataaagtttctttcctcagcagctgaaattgataggttaagctaaagatgaaaatatctagcatttgctctcggcttgaagggagcggcatgtttctcaggaagctctcgcctgggagctcagtttgtttgagttctgttatttctagtgatgctagctaatcatcttttagagtttcagtttccctttggctatgtcaagaggtcgagtgttataaactgccttatgctttcctcacttagatgggagggcccatgtaattctgctttcgaagagcatttagcttctccaaagaaaaacacttaaccaactaatgaatcataagagttctaaatgcttttcttagtaatatctcagttttactctgtagtggcagaaaaatttagacagctatgatttcctcagttttagtgttggagaagactaaggctgggatttttcaggaaatgaatgatgttttaacttgaaaagtactggatcacaaagaacataacatgcggtatgctttcagtttcttttagaaaaaaaatcatgaattgaaaaagttttaatagctttccatgtatgctaggtatttctataccattctggagacactaatcaaaggaaatataaacacatatatcacaaaggattgaaatttgactttaagagggtgagtggcaatggagctcctcgatacacttcccgtttcacaggggaagagatgggaatttgcagaaaaactgacttagttctgcctggatgtgtcaagcccatgagccagagctggtcaccatcctgacccacagtagaatcagtggttcagttgtaattttctctctgatttatctaaagagatcactgttaagaattctgttaggaacctgctttatcttagaaatatgacaatgagtaaaattgtgaaatttttacactgttttggtgcatatgcatttatgttgaatactattcaatggaaaagtattgccttatatatctgctctgttcagtttttgaatctttcatgccgttgtcaacttttacaaaagaagaatttaataccacattatttcttcttacatctatttttgaaaagcagttattctcaacactaccctaaatatttaaaaagaaaaacatttcactaacacaagattttgctatttgatatctccctgtcaaatctgaacagggtacctttacaaaaatctttgaaaacaacctttagaaatagtctggaatcagtttatgtcaaacaaatgtatgctctaaatcagcagtccccaaccttttcagcatcagggactggttgcatggaagactatttttccaagggaaggggggattgtttcaggatgaaatttccacttcagatcatcaggcgttagttattttctcataaggggcatgcaacctaggtccctcacatgtgcagttcacaataagattcgagctcctgtgagaatctaatgctgccactggtctgacaggaggtggagctcagttgttaatgctcagttgctcacctgcagctcaccttctgctgtgccgtgcagtttctgatgggccacagactgacaccggtccgtagccatgggattggggacccctcttctaaataataattctaacaagccaccttaatattcaattcaagaatgcagtccatgatcaagtaaaatgttgttagaagaaacaggtttcatatttcatatctccagagagtctttaagaccattagactattcagcaaaattatccatatatgatttttattttttgcttcccattagccaaacccacatatattattattacttttttaaaaactgcattagtatgttctaaagcttccttttcatttcttttgtggttttaatctttggagagtgagctagaaatacccattagagatgaattctaggaaaataaatgtaagcagtaactctggctcaatttatttttcttctctacaagaactgtttaaaacctggcagtggaagactattctcttgtctaccaagtattatagtaggaagtgcaaggtcatctctaaatataaaagattctatgtttctaaggaaagagtgtatcttaagaagggtaaatgaaatagttggctagagggaaagggaaatttccttatttcaccctgaaacttggcagcatttctgaaacagagcttgaagctttgagatgaattaaaaagagtttgtttcaccttctatggaagctcttttgcacccaatttacttttcccctgtctggtcaggaaggcacttcatcattagagattttgtaaaacttcatcggttgattaaaatgcagatagcatgcctctcggtgagaaaataattttaatattgtcagttttagaaatctgcctacataaaacatacgtgagaaaaaatgtgttttcaaacctgaatttttatgtaggcttgttcactaacttctccatttcatcatcagaagctcaccctttcaagctacttcgctttgtgtgttgtggggagactgagggtgggtaaggcattttggcacgactcaaactggtccattttatttcaaataagtcctgatgaaagggcaaatcctactctcagcataatcttctttagaaataggaggaataaatgctcctaaaatgaatgcatagtaaggaagggcagggcagatgccatgatctgggtgcaactcttaagctgatgtgtggcccaatgatcctcatacgtggaagccgaatggaccatagcaccctagcttcctttatagtcccctttgtttggttttatcagttgagggagatggcctacttctttgccatgtgagtaaacaacagaatgcaactaatcttctagtggaagatcatggaaaaagctgctacctatgactatagaagtacatttcaaaatttggtgtaagtcagaaataaagtcctggaaagtagttaaatttcttcaacacttcagggctaacttttttttaagttcataaactttactttttagagaagttttagatttacagaaaatttgagcagaaagtacagagaattcccatatactcctcatatccaacccaccgcagtttcccctataattaatgtcttgcattagtgtgatacatttgttactttgataagccaatatcaatatattgagacccatagttattttttattttttttcttcatgaacccataggtagagattcatagtttaaatcagggttcaccctttgtgttgtccattctgtgggttttgacaagtgtataataatatgtatctatcattatagcaccatacagagtagtggcaccgtcctgaaaatctcctgtgctttgcctgtcaccctcttccaaacccctgacaaccactagtcttttcactgtttccatagttttgcctttttcagaatgtcatatagttggactcaactatgtatagtgttttcatactggcttctttcacttagcaatgtgcatttaaagttcctccatgtctttttgtggcttgatagctcatttctttttgacactgaataatattccattgtatggatgtaccacagtttgtttgtttattcacttattgaaggacatcttggttacttctgagttttggcaattatgcatgaaactgctataaacatttgtgtgtaggcttctgtgtgaatgtagtttttaactcatttgggtaaatatcaagaagtataattgctgaatcaaatggtaaggacatgtttagttttgtaagaaatgtcaaggtaacttctgatgttctgtaaatacttgcggatttgaagaaagaaaaatgaagcagaaatgatgtgatgcctttaagaactgagacccttgcaattgattggaaattaagtggtctattgctatatgtattagcttagttttattgaagacatgtagggaagatcttcccttctctattcttgttctaggtaaaaactgctcagaaggttttagcctatgttttaaaaaatagctgggggaaaaaatgaagccttcagtaagtccagatttgtttggcctcataggatctaagattgcccattaggaatgcctgttaaattttgtgtcaaaactcccctacattcttgcctttttctttatcattcctcctatctttccctataaccatagcctacctgccccttacatgatctttcaatagtgttgtttattctcctacccctcattccagttttgaggagaaaggttgagcacacttctccttgatgcctccttctaaagctttaaactcttgttccagtgccatctctgggaaccctactcttctctggaggctggtggacagctgacattctgacttttctcatccacattaatgttttccactgacctccaggactctctcacactctttagttttattattcttattcacgatcttattcctcaaaattgccatcccccatcagcacctctaaacactgtctctcaaagggtcatataatctctgggaactaatgttccagcttcaaaattgagaactttgaatctctcttatctcatttgtctgttcatcataattctgttttctcttcactcactcttactgaacctgtacttaaccttttttgtggtttctgatttctcaacacccatattctaacccattagctcccttgattcctttctcagatccacaatcaactctatcaacaaggctattaccagcacctaaaattgttcttatctcttgtccttatgccacatctgccttgtcaacctctgtcgtatactgtctcaactgtatttctctcccttgatggagaaagttataaggtagaaccttttcatttcacatacatgcacagagtgatatttaacactgagcctcatttgctaggcagtaaggaataggaaagaatccaaatttgttaatgcattcaggtcactctagcactccatgacctggctttaatgtaaattttcatatttgtattctgttactcctttatagcctctcctgccaaactgtactgtttacttttctcatatttctttattcatctgtgtgttttatcttacaccagggatggcaaatagatttcatcttatatgactgttctgctcattgtggcaatgagtaggtctatgttgagaaggattctgatgctcaaaaccaggtcagcaagagattgcaatgatcgactagtaatgaccatcatgggtatggaagatggaaggaccatgcattagtggggcattgcccagcgtttgccacatattttcccctcctgctttacattcttcatgtgtgattctatacatccctcaaggttcagattaatcactaattaaaagaaaacttatatttttattccacatatcttctctttatagattaccatatcactttagatattccctgtgtgaggacaggtattattgggtatgagtacatgtgttcttcttccttctatattgttagctcttccaaggtagaaataattcttaattatccaattttgttgatcacaatggaagcatgatgagaatccacaaggaaaatctcaaacagttggcatgaacacaaatggagtatcctgaactcacttttgacttaaaggtcaagatggataatggaggaagtatccatcccaggctctgctactactctgcttccatttggttgtccttcccaaaactttacatacttccaaattgaaagattccctagatctgaaaggggaaggaacaattttagtaggtctggtgaagaatatagaaacttactcttattgcaaatagttgaaacagaaccaaggaacatttttgacttgtctagtttcacagataatgctaacattaatcatggatttctgaatcaggtttttcatctttttaccaggcagtgcggcaccatatttaataattattttactcattttgagggaacatgtattggttgtgctattattttgtcacatatcaagttttatgcaattagaaattaacccatgggttttgttgaagaagtacacattttctgtaaagtaacttttcattaggaagaagcttatggacattactattttttatttttggcaagtaaacttttatttgaaatatatatacagaaaagtggtacaaacctcaaatagataatttgatggattttcaaaacagtgaacccatctgtgtaaccagcacctagatcaagaaataaaatggtgtcagcaccccagaaggagcacaccttctcccagttgctgcctcatcctaaaggtgaccactctcctaatttctgaccccgtaggttagtttgacccatttttgagctttgtataaatgagtcatataatatgcatcttcgtgtttggcctctttccctccacataatatttgtgagatttacctgtatttttgtgtgaagcaatagtttatttttatgggtgttcagtattccattgagtacatataccatattctgcatcttaaatgattcttttacacttactgtcactcttaaagtggagttgagaaactgagtataaaatgtctaagattataaggatctttgtgttatttaacttatttatcattttcattattttaatctcttcatggaaattgtggctaaggatttctaatatgagctctaaaattttagtattatattctagctatttgaatacagtgaatcaatattgtaggcctttggaaacgtttttaaagtaaatattacctgaaaaaaactagtttgttgtaggattaaactctgtgttctgttcttataacttcatatatggcatttcttgaaatgactgaaggaattcttggatttaaaggtcatctcgatttccctaggaagtcatttagacattataaatgatggtttattcagaagaaggaagatgagagatggagatttcctgtcagtgcaaggatattggaggacagacttcaacatattatttatatatattagtatcttatccagttcagctcaaggcagataataggtgatgttttggtgctgtgtgtataggttctagtagattaacaagttattcagccttatggctgtgttttcagatttgaatcagttaatatttgtagaacatccgtgagataaaaagatcaagatgaaggcaaaaaaatgacacaagagctctgaattcttacctttgaggggcggcatacaatttattcaggaaaatgacaagtcaaagattctacaagtttgacaattagctactaaaataaatattttacacacacatgctaagtgtgtgtaattgaagaggggtaaggagggaagaatatagagtatttctcttaagtagactaggaagaaagataggacatttgagttagactttggaagtaggagaaacgagataattggcatagaaatgttggccatgaagtggtgaaagccattgccatggaaaaagaaggcataaaggagcctggcaagaaaagaaaagattcactggtgtggagggagagggaatgaggacgtggtcagccttttcttgggaatttgaattcgtattccaggtaaaagaatgccaatgcagtgcttctcagtagtttttaagcccatgcctcctttagataaacatatatctttaccactccatcctaaaactctgattacctttcctccccataatatgtaggtgattatatttcctacgtatctccagccaagatgattttgttaagcttcactctctatagtatatattgtagagaaaggattccccccaaatgtaaattagatgagaatgttgagttaagttaataactacatacatcctggggacattctaacatgcctgtgtgtgtatgtacttcttcatttcttctccatcctttgaaaatcaccaaggctaagtgccatagccaaaagaataaatgagaagggtgaggtttcctctccagtgcacttgatactaattgaaattagggtccacagactaggaaatttagtgaaatgggtgtattaaaagaacgagggtctggtcgaacagtctactctgagaggaagaggggtataaaatacaatatgaggaaaaaaatctgaaagtactgttcggaactacgctactaaaataggctgtatatacactttttccaggttttttggactttgtatagaaaatgaagtgttttgttttagccatttgaaggattatgtgtctgcatgacatttggtggaagtatttgataagtacaggaaataaaagatgagctaataagagaaaacaatcaggactggcaaattagatttggagatgattcatatagagatcattataatcgcaaaggcaaattatgtttaggaggctctgtatagagaacaactagccaaaccctgagggaatgttaatggtagtacgagagaagcaaatattaggtttctgtctgagtattcagatgaccagaaggcaaatcaccaggaaaatatattttaaaagttaaaattaggaatctttttggggaggaatttatttagatttaaaaacacatttattgaggacctactgtggtaagtgctggggttgtaagtataaataggatagagtcccctaaacctcaagaagctgacaaatatggtaaggaataaagaactgaagacaattggggtgtaatgtgatgggtgagtgcccagtaatttacaaaataattattttcaaacttaatttcacccaggcaagaaaaagtagtgcaaatatttagggtaggagggtgagaaagcaacgaagtcgcacaaatattgtggttttatagtaaatgttgtcaaggtggagacatatatggatgatagatcctcagggatgttttatgggtttaatatatacaatggaaattctttagaaaagtatttgaggagttgtgcagctgtattgctgatatgagacttgtggtttcttttccacattttataactatgaagtagtaggctgggtccttgaataagtgtgtgttctttggtttgcatgaatggtatgtactttgaattctcaaaacagaactccagtttattttctcagtagtcccagtgagaaaagctgtatttcttaaatatggtcagaaagcacttgacggaggagtgtttactgtagaaacctgtgattgtctgcaggtaccagcataaacatgttcccattcctcatcccgggggggtaatctcattattaaacctatgcaaccttcaagttagcttatttttaatgtttgtttcatattttaaaagcaagaagtgaacacggaaaaaagtttaacaatatgaaagaacatataataaatggtcagccccagatcctcagtgccccagatcctcagcaccccagaggcaaatactgttaacagtttctagtgggtctttcatacaatagatgtttttattttcatagagagaatggcttttatttgacctctggaatacaaaaaggtaactgtagtttccttgcaatgcagttggcaaattatttttaccttctttttccaagcagactctgaaacatgagttttgaggagcaggattaaatactctgacctaagagacccagatatttggatttttatgtggacatgtactcactgaaactgaaatttggaggaactggaattaataacattttccctcatgtaattcatggaatttattgctttggctctaattatgcatttatgttatattctgaataatgcaaaggagaatattgaaacattttaggccgtcagaacacttttcccgctctcaagctgtctccctattgtatttgtgctgaaatgccaagctgcatgtgacagtagaagagttggcagtatctgtcttagaataagctttcacatgcagcttcaaacacctttgtggtttgggttatattttgacagttgctaggtagcttgagtcagagagtgcagctgtgcaatttaagatgtgttttcctatcctttcctctaaagagagctaaaaaaataaaactataatcagatttctaaagtgttaaacgggataaaactatttagaacccatactatagaatgaagtagatgaattctgataaagcacatatatactaaagtataccagtgaatttatttcagatgaaactaggtaggctcattgtaaacagatgagcttctgaaatttctgaactgtttcattgaaaggtaaaacaatgggtttgggagcacccacacttcttggcacaggtgagtggttggcactcattaaccaccgaattctgacacgaacatgctgtttatgaagaaaaatcagggaaggagactaagatttctgataagaaagagtagaagaaaaggtagaaattcaacttacttggtaaaacgggagtacgtcaggattagaaatgggctcttacacaacgagaaataaagatagctttttcataggcttcctattctgagagtttttcttgttgatttgtagagtgtaaatgtacttcttcctgaagacaaggactaggccgaggtagtttgatgtaaatgtggggactcatttgttatgaacccatagtagactgctgtgggaaaacattgtgaacaaaagaaggagtcaaaaaataaacaaaacattttgtggcaagttatctaagacagatcctggagaagggctgattgagaaggtaaactagaacaaacggctttaaaaataatagacaaggtcaaaatatttctgggcaagaaggacaatcaaaccacttgcaggtgttgtgttgctgcctagagactggtttggcctgacccaagtgatggtgtctggagccaaaccttttatcaggagaaatataggaccacagagatgagacaagtactaccagtcctggggaagtaaagagacggaaaattcctttctttaactagagggaatggaccctgcagtcaacctgtgtacttgcagagctatatgtctttggtattctgatatacttcacaaagtatattttatgccctaggtgctaagtgaattgacaatgaagacttggtattgagggaattaaagggcaggtggggttctgttcccaaggctacagtccatagaatattggcaaggtggagacaaacatgacataccatcttccctgccttctttaatccctgggtggatggtagcaggcaagagagtaataaatgcaaggaacagtaggtttgcagtacccttggtattctgtcatatgtgtaattgaaagccacaacaaaatagcaatagaaaagaaaatattagtgaggcggctcatgcctgtaatctcagcactttgggaggctgaggtgggaggattgcttgaggccaggagtttgagaccagcctgggcaacgtagagagaccccatctctacaaaataacaaaaaattagcaaaagaaaaaaggcttttttgtgtgtgcgtgcatgtgtgtgtttgtgggaagtcttaatttttgccttgaattttaaaggaagatttaaatgattaaagtaatgattaaagtaattgtgagatgtgcagatgacatagaataatggaaattaaaaaataaatatttattgccttttctcccctgcttacaaaagcagtacagcttaatgcaagaaatttggagaaatgtaaaaggagaatggcatttaaaaataaccttaaaatgttttttttcttgaaatattcaatggtggtggtgggtagagagtgagaggaagaagctcctcatagactttgagaaaatcaagaggttttaaagagcaataaaaggaactgagcacatctcctttaggatctgtagaactggccttaaatcaatacagaaatgtctagcaagaggcaatctctctggggagattattaaagtgagagtagattatcatttgagtgactggttcaggttctctgaggtgctcttgaagtaccactgactgttgaagcatgtatctgaaatttccttttaacacaagttttcagtgattctcttagaggttaaacacacagacacacagacacacagacacacacagacacacacacacacacacacacacacacacacacacacacacacacacgactgcagccaggaagcctggctcagtcaccaggtagtggtatgcccttgggcaggtgatttaacctttccaaggtttagcaatttcctcattagtactgcgacaggattgaatcagattttctccaaggtttctacctgctctaactgttttgttttaaggaattgatctcattttctcttcctgtctgtctcaccccaccatttccccttgtcccaaggtaattaagccatttccagttcagacagtgagctaagtgctttttggaacatacgaactcaaggaatgcacgtttttgtcaattatttgagaaagtgtgaatcctgcatggagtttagaatatatgattgtcagaattgtcttgataaatatggtgtgtgtgtgtttgtgtgaaatagagaatgcatgtaggaataaacgagcaagcttataatttttagtaatatttggaatgagaaaaattaggagggttcagtacttgataagaaggtgggtttcataagtagaataaacccgaaggccatatacatatcaggagagttactttatggcttatatgttttttcccttccagtattatagaagacaggttatattgtctgtacaacaactacacctacctacttcaggtgttcatctttggagtggggacctacgggaatccctgagttggtataaagtttatttcaagctggagacatttgagattcaagaacacatattggagcttcccttatctgactaaaagcagcaacttgtgggaaatgaggctaccataaatcctctctccaggagagtttcatggccatgaagaagacagaaagaccacttgcacctccataaacaaacattatcacaaactttcttatataccgtttgctctcctaaaaattgatttgcctttcctaaggaagcctacctgtttttcccataggagcttcctcccctttccccacaaagttaggtatataagtctcatattctaaccacccctttgagttagtcatcactgggcactcccacatgtgtgtgcattgcacgtgtaaataaactccttcttttctcttgctattttattttctgtcagtttaattcacatacctccaggaaataaacctaagagagcagcggaaaaacttttttcctccctgacatctgttttatgtaaatgcagtttttgtaaacatgaagataggatttccggaaacttcagactttgggagcagttctacatacatagaaaaaatacaacaaaacagtcagtacagatgcattttagtaattacgtagcttatcaagtaataatcaatctagaatctgaagagttttttctattgcacagtgatagaagtattgattagctatctgtctggaataaaagcagtgctctgattggctgcagtggtctttatttgaagaagcatatgaagctattggtgtttatggcaaggcatgctgcctgagccgctataagaagaaagactttcccaatgacacctaaaatctgggtacaagtgataagaaagagaagagacaggaactggggaaagtagtgaaaagcagtagagacagtgggggagaaaagacattggctccagggggagcaatttcacttctcttacccctcacctgcaggtcctggtatggaaataggcatgttagaggagaccaggaggacaagaaggtctagccttggacaaagttcaaggggcctttagaccccaacaagatgaaatagaagaagtactggcacctggccccattcccctgactccacctcacccaaaccctgatgattatatattaagattgcatttctgtaccaatgtgaggccacaagatagatggctcatggctgggcatttggatttgctgttggtagtaaaaggtcaatgtagaacaatttccaaatagctctcctctcatatatgaataaggatggttggcatttgattttgctatgtattttaaagctgcagcaaatgcagtgaatgaattcagcgacagctttggccatgtttttgatgtaccgggtggtgatagttggaggtaggagggacttaatagcatgtggaatgagggcaaaaatatcattcaaggcaacgtgcctttcaattcctggcacctcctgttgcacagctgcaatgtggtagggtgggggagggagcagggaggatggtggggagatggcactgctgtgtgctgcagcctgccctggccagccaaactcttgacaaggcagctggagagtactgatcctggctctagattgtcatctgattacacattgttttaccaacttcatgactgttatctgtttgctacagcttgtaaaaaaatctctatgcttggaatggcatggtagtgattaaaaagagataggaagcacttaatatgctcattcatttgcatttattgtagattaaaggaggagatgaaggtgtgtaactatcttttactattgctctcaggattaatatatcatattgcttctgtcatttaacatttttataccgatggatttttcttcaatgttcatatatgtatagaaatgttgatagatgccagtcactgctaattaatgttataattctaagatgctggcgggttgtaggtagctttggccaaggtcccttctttaaacctctcctattttgggcctgagggtgaaactagtcactccttttagaaaacagagctagacttgaatcccagagcagccactaggatatctatatacatctataatatgtatctatgtctgtctatctgtataaattttgttttattatggtaaatatatttaacataaaattaactattttagccatttttaagcattaagtacattcacattgttctgcaaccattaccatccatctccagaactttttcatcttccccaattgaaattctatagccatgaaacataaactccccattttctcctttctccactccctggtggccactattctgctttctgtctttatgaatttgactcttttatgtacctcatataaatggaatcgtacaatatttgtccttttatgactagcttatttcacttagcataatgtctttaaggctcattcgtgtggtagcaggtatcagaatttccttccttttaaattctgaataatattccattgtaggtatgtaccatattttgtttatccattcgtctaatgatggacccttgtgttgcttccaccttttagctattgagaataatgctgatatgaacacaggtgtgcaaatatctgtttgagttcctgctttcagttttttgggtatattccccggaagtgggattgctggatcgatcatatggtaattctagctttaattttttgaggaactgtgatatcatttcctaggacaaactttaatttctctgtgcctcaccttccttatttgtgaaacaggaataatcatccttaactggaagagggctatcagggttagagataatgtagttaaagtgccagcatttcttgcctctagagccagtagcaacaaaacgtgtagtttctgcctaaatcttgctatttctcactgcctctgctcttgctgtctctctgtttgtaatggcctttcttacctgactccctcctatgcatcctgtaagacttgttcaagggctgccttctctaggaagttgtccctgtttctacccaagctatattgccccattttatgcttttatggcacctctatcattgtacctgccacactgaatagggattatctcttcattcttccatctcctgtttgtagactaatttaatatgtactgaaatatctaatatgtggtcagtgctggagattcagtggtagcagacacttataggatctatctggagggggcttcatctggaccagttcctcagggtgtgttcctaaagaccacctcacctgcatcagaatccttggaagctttggggacccatgctgggtctgagaatctgaattttaacattccccttgggtgattcttacgcacattattagcttgtgagttcagaggttccgtgagggcaggccctgtgtcacttcaacactgcatccttggccctgagtgcaatttctggcacaaaacagttacacaaaagtatttgttgaagaaggagggtactctgaattgaaatggggctggaatttaggagtgaccagcaatagtatgaggttaagattaactctaccttttcccaacaagtggaataccaagccaattcaaacataaatctaaacatatattgatttcttactgagtgaggcttctctctgcctcagcctcatctctaggagatttcctaaaggaaggaaatggacccattttcgtcttaaattacattacattgttgactagttgagagtcttcatgcttctttagtttccagcaaaaaaaaatcttcaaatgagtttttattaagcattataatgtttgcaaaggtatatagtgcaagaatttgaaataaagttttctggatgccataatttatgttaacatttatttataaagaaatacatacataatattataaaattttgtgtacaaggactccacttgtgtatctgtatactagggctatattttttgttgaagtgtaatgaggtaagtttatttttaagcatttgtgtaaggagaaaaggagggaagatacaaattacttaagggcctgaaattactagcactcaggagttgcctgaattaattatggagggtctcagttggatggcttgtcactttttttggtactgtaatgccatgctttcccctcccccatgcttttgctttttggtttaaagcttaagctaaatattattctgaaaattacatgtttaaaataaagacagaatttttacagcttgtcctgtggtcattgtgaatattcttttggataactgaaatggtcagtcactaggataaagatccttgtgttagttgaggccctcttttggctaatattctgggagcaagtaacttaataaagctcataaatattcaagtcagtatacggatttcctcatttagtttaaggaaactggggaaagaattttgttaaactgagaggtgggctaagggaataaactgttccttgcatccgtgtttgtgactggcacctgacattagtttcctctcagcttacatgcttgcccattctactgtaagtaaatcccactcttcattttagctttgccctttttcctggcacactgctattttttttcagagctgaagccgcttaatccccacatgtggattctgccctggtttaggtttttctaccagtcctgttcttagtgacttaatctggtcattcacaacaaatcaatctttggttggttttgctatgcctttgtctgattctattaataagcctttttcttgttccttgtgaccaaaattctgcactatcactttctttccaccttttctgatagcccagctagtctggtcctgggctcctgcttggattctacaggcttctccagaacaatctagttggctgggttttaatttatctgcttccatgtctttctataattccaagagcctagttacttacacctctagctaactttactccttgcctaatgtaggtttgccaacttgatgtccttcacttgttccacatcacttctccacttgggttagtctttgtgcctagccttctttaacggggcccatcctgcttcacctgaatcctgattcagatgaccaaagaccaattcagtggctaaattgttaatgtctatgcttttaattcactacaggagaaacatcctggttaacctctgcttctcagtcagttgttcaaatgtgccattggagcaccataaaatatgtcacttcagaatgttactcagtaagggcacctgttttagcttggtcacctcctttgaacctaaaacagaggccagccatatctacagcaagtgtccccaccaaattttgtctcactgcataagctttactttctaaggtgattttgaatggaactttaagaacatatcagacaattttgagttacttgtcttgctgtgctttttattttattggtcttagaggaaacacacatatgcataatattttgtttcccaatttagggagttcatggactacttagaggtccagccccgtaggtcatagtgacactgtgatggaacgtttacttcctttttatagttgtcatatccaaccatgcttattgtaaagacaattgataaatgagatagaagtcgagataagttagaggagaatgatgctaaaatttctttagcattataggatcttagatttatgctgtttggcttactgttactacaatgacagttttctaaatgttatttttataaaacaacttaccaaaaggtacctatgcaggaaatgaacttgaaaaaaatcagaaaagcatttatctttaacagaatgttattgtcaacattttaaatttattgtatgtatgcagttacgaattatataaaagtgagttttggctctctagggaagaatcagttggaattttattaaatttcaacctggactattttacttggaagttgaagaattacagctagcctagtggtttatacaatatataagatatgaaaaacccttcacaggacatttcattgatttgtttccaagtttagttcagacaaccaaagaccaatgtataggtaaagatgaaatgagccattattttgccattatttgcaatatttgtgacttaacatttattacctacaatattcttcattacctttattctgttgtttaaaactacttttaaaaatacattatgatgaggctttttgaagttttttcaaagtggtctaactttaagacgattgtatatttagaattcctgtactttaaaaatatttattgagaatgaggggtgggaagagggagaggatcaggaaaagtagctagtggatgctgggcttaatacctgggtgatgggatgatatgtgcatcaaaccactgtggcacatgtttacctatgtaacaaacctgcacatcctgcacatgtacccctgaacttaagataaaagttggaaatttaaaaaaaagagaatgaacttttttttttttaagatcactttgataaggagaaagtcaatatattgacagaattttacagctgaagctaccagaaatggcatgtggccatctctgaacccttcctgcattcttttctctataccaggctgcctggcatgcttttaaatcaccaccagtacaacctctgcagagatcttcagctatattctccagcagcttaatttttctcccaaggttaaaccttacacagaaagtttgttctctgataggcataggtacactgaataaactactatagtactgctgatcagggcttctgactttgaaactgagctgcaaaacaaataatcagctgattgtatcagtttagtgaggtgaaaagctaggaattccttgcaaacaagcagtctatttaaatgttaaaagagaagaaatctggtttccatgttgtagtaatgattcactagttttctagtgaaggtcatttgaaaggagagtgagcagtgatgggtctagctgaacacagaatgattaattacaagttattaaagcatggtttcactctgggcttattgtgcataagcaagtttatatatgcacttgaagaaacttgatacaaatagaatgaatgaaaaaatgcaaaggcaagggcataaaataggtaggcaagcaagatggcagcactcaatgtttctggaattatataaccttgcccaagaggaagttgacatatggtgaaagggatcttgaaaaaaaaggaagccaaaagagtccctgactgagggcatttactctgcagtttcttcatctaatcagagaaatggacaggaaaccaggccctcttactcctacatcatggggctgttgaacatacctcatgagagagaagtacttagataggttttgcagtggggtatgtttcggaatactgaagtagaggtgttttcaattgatataaaacttggtgtggagtagattacaaggtcaaaatgaatatgtgatctattggtagggaggtagcctgggtattgcaaagagcacatgttttggaaacaaagggacctgagctcaaatcctggctctccagcatgctatccatgtgatcccaaggcaagtgacagccactgagttgtagctcctcttgtaaaataaagtaatgctaaccgttgaagtatatttcctgtgaagttaatgaggcttagcgaatcaagccctccaaagggcctgagccatgtgttcacatggctgtttttattaagcctgtggtctccattctgatttttcctctatcgcgttctcccttatgcggggtggtactgaaatggccatggatatttttgggtttataattatatgtttacttcctttgtatgtacattttgtattattttcctatttttatattatgtgtactatttttcctaatgaaagcttcccaaattggataaatttcatgcctcacaaccctagggtctgccatgtttattttgtaactttcttattaagattaagcaaaataatcatgtaaagcactttatcagttatttattgccaaataacagcccattccaaaacttagcagcttagaacagtaactattttatttgttcacaattctgtggatcagcccttcagcctgggctctgcttggtggttcttctgctgatctggccttggctcactcttgtgatagcagtcagttggcagagagtaggtgatctaagatggcctcagtcaactgtctggcagttgtcaggctattagctggttaccttgttactcctccatggggcctctctagtggactagctcagagctgctcacatggcatagcctttaaagagggagagagagaaaactggaaggcctcgtgacgtctatgcttagaactcccacttgtgctgcattctattcatcaaagtgaggcataagattagcccagatttaaggagtcgaaaagtagattccattgcttgatagaatgagctgcaaagaaatgtggctgtttataatctaccactagctctgcctgaaataggagatcctgaaatatgttagctttctcttcttcctcttcctaccttgcttcttatttctgctgaggttaaataaacacgaattgaagagaagcttccatggaagaagagaagaactagacataaataagactccctcagatgtgtctgatactcagttttataaattcttaatctgttgtttaaattagattgaattttaaacctacttataccttttaaaaataaaatgcttaaaaattttactgtattttcttttaaaaagtttgtatatgagacattaaaatgtcttgcctttttcagtttatatctgtgaaattgtgaaatatatacagtgatgcaccacataacaaaatttggccaactatggaccacacatacaacaatgctcccataagattgtaatggagctgaaaaatttctatggtctcatgagttgtagtggtcataaagtcgtagtgatatctattacctttcctatgattagatacacaaatacttactattgtgttatgattgttatagtactcagtacagtacatacagtataggtttgtagcctagaagcaataggcctgggtgtatagtcagctataccacctagttttggataaatacattctatgatataagcacaattacaaaattgcctaacagtgcacattacagaacagatctctgtcttttaaaaaatttttttaagttcaggggtacatgtgcaggtttgttatataggtaaacttgtgtcacaggggtttgttgtatagattattttgttacccaggtgttcagcctagtacccatcagttgtttttcctgatcctttccctcctcccaccctccaccctcaggtaggccccagtatctgttgtgcccctctatgtgtccatgtgttctcatcatttagctcccacttacaaataagcatatgtggtatgtggttttctatgcctgtgttagtttgctaaggataatgtcttctagctccattaatgtccctgcaaaggacatgatatcattctttttttatggctgcatagtatttcttggtggatatgtaccacattttctttatccagtctaccagtgatgggcatttaggttgattccatgtctttgctattgtgaatagtcctgcaatgaacacatgtgtgcatgtgtctttatggtggaatgatttatatttctttgggtatatacctagtaatgggattggtgggtcaaatggtagttctgcttttagttctttgaggaatcactacactgctttccacaatggttgaactaatttatactccctccggtagtgtataagtgttcccttttctctgcaacttcaccaggatctgttattttttgactttttaataatagccattctgactggtgtgagatgatatctcattgtggttttgatttgcatttctctaatgatcagtgatgttgagctttttttcatatgcttgttgacggcatgcatgcctcttttgaaaagtgtctgttcatgtcctttgctacattttaatgggaccgtttttcttgtaaatttgtaagttccttatagatgctggatattagatctttgttagatgcatagtttgcaaaaattttctcccattctgtaggttgtctgtttactttgttgatagtttcttttgctgtgcagaagctctttagtttaattagatcccatttgtcaatttttgcttttattgcaattgcttttggcatcttcgtcatgaaatctttgcccgttcctatgtccagaatggtattgtctagattgggatccctgtcttaagtggcacatgactgtgtttgatcttcacccagtttcctggcatacaactcctaaaatccttaaaatctccaaagtgataagcgtctctttgtttgctaatgagatgactggtggttggcagcccctgggtagcttcaggatgggggctgatcacaagaaagaccaaggcatgattatgtagttggaactgtttaagccctattccccaacctctgagaaggagagaggggataaagtttaagttgatcaccaatagacaatattttaatcaatcatacctacataatgaagcctccataaaagctttggataagcttccagatagctgaccacatgaaggtttctggaaggtggagcacctaaagaaggcatggaagctctgtgtccgttcccccatacattgccctatccatctcttatctggtgttcatcagtatcctttgtaacatcgttttaaataaaccagaaagtataaataagtgtttccctgagttctgtgagccactctagcaaattaatcaaacttgagtaggggattgtggaaaccctgattatagccgattggtcagaagcacaggtaaaataacctggaatttgcaattggcatcagaatggtggtgggtggaggataaggaggggaagtcttggggactgagacttcaacctgtgggatctgaactacctccaggtagagagtgtcacaattgacttgaattagaggacacccagctggtgtctgctgcagaagtgattgcttgcttggtgtatgggggggaacccctacccctacatttggtcacagaaatcttttgtgttgactgttgagtgacagtataggagaaactgactttgtttttttcctatatcctcaatatcaaataaggaatttgctgaagaaagcttggttttggaatgaagatgaataataatttaaaatacggaaaaagtaatatatttagcaatttgacaaaggctcacggcactcttctttttcagtttaatggaattgtatatatgtgattaagaaaaccaataaagcaaacttctagcattttcccctttaagtgataattaattgtctccttattgagtaattaaattaatctgagtctacagatagatgagttacatggattttaataatttagatagcatctataacttttaagaacctgttaaatgattatgagaatcaaccaggttctcctggtgatgccatgatcataataatctgcactgcatctaaaaacaatcatttggagaattagtttgaaatactgttctttatataactgacaataataaatattttctgataaatgctaacttgatttgctgattattggagagctaagaataataagtgaaaagagatacggaaataaaaggaaaaggaagtacatgctactacttgtctttagtttatttctagtgaaatcagatctattagtcaagacatttagttgcaaaagacagaaaatgtaaaatgggaaattattggtcatataaagggagggttaagaggaatacatttcagtacagctggatgtaggggcctgaggaggtaatgaagacccagtttttctttctccatgttttttgtctctttcttctgtgttggtgccagtctcaggcttgatgtgggaacactttagttgtaatagtttaaatccctgtattcttttggtttaagtacaatagaaaagaatggttttctaatctcaggaaaatgcctgagattagatctgtttaggactgcttgatctggtgtgagtcatgtgtctgtccaaccccagatgaactagaaggatggaataccttgattgtctcaggcctctctcttgcttcacttgttgttcttctggaacaaagtcagggaccctcatcctaagcccacagattgagactggagaagagtagattctagataacaataggagacttcaaaagtagggtaaagctgacatggcaagccaaacacagctagggtctattacaaatgtaacgtacatgttcctggaacgcagtagatgctcaataatatgtcttaaattagagacggttgttagaaaaggatattttagccttttgagtttttgtgtattttgctctcggaactctgctgggtaaatatagataagagtttgcactctctggtcttttcttaaagcgttttttttttttttaatgattatgtgcctttcacgcaattatttagcaataataatgttctgattttacagatggaagacactgaatgtgatgaaaaggcttgatgctgtttataaaattcagtgttggacaaacttaaaatgttttctccattaaaaatttgtaaattgtgtttaaaagtactcaaaacagttatatttgcatccatcagttatataaaatagtattatgactattagtctgataacagatagataaatgtgatcgattattgcatgtttctgggtagcttgtcatatcataaccatttctagaattcttggacacatttaatgtattcctttaaaaaatcagaatggatattctgatttgttctgtctgttggtaaaattcaagtcagagatgaattagctcctgccaacttggcctatttaaatagtataggggttttatacaagaagatatcataaaatttccttttattatcatagattactgtataaataggtgatcatctaatcaatagtccaaactaggacattgttgagagtgacaggggaaaattacattgtgagaccaggcagaatctagacaaaccaggacttgaagtcatcccgtgtataaacaatacaacttattacctgtacacttaatattaaatttctctataaggaacagtgtcagaggactttttttatactgcagagcactttgataagatagctgttggtcatgtgacttctttggtatggcctatttttcctttaagaattaataacatcttaaacactcatagacatgacagcatttggaaagtcccagtgcttctttctctatttttctagcagagtatttagtaggaggaataattaattttttgaatgacagatttagctctctaaccatgtccctggtcacctcttagactaaaatagatcatgccaggtaaactatgataataatgcctgataaagatatcttgatggtgtaattgacaatacctcaataaggcagtggaggttagaagaacaatgagaagtcttctactgtcccctgccaatttcagtatatcacatggaagttatttttctgttatccttgtccctccaggtggcatttaagatttgagcatcatggtaacagagggccagagaatgaaggaaacaaatctcatgtcaactctttcttttttttttttttgtttctctatgtttcatttattttttaaggggtgaactctctttgttaagtataatttctattctataatagtaatttaataaatacttaataatgtgaatgcatatttcaatagcattctttttttttttttttaacacaggatctcactttgtcacctgggcaggagtgcagtgacacaatcacagctcactgtaccctcgatctcctgggctcaagcaatcttcctacctcagcctcccaagtagctgggactacaggtgtgtgccaccatgcctggctaattgttttgtagagatggggtttcaccatgttgccccggctggccttgaactcatgggctcaagccttctgcctgccttggcctcccaaagtactgggattacaggcatgaacactgcacctggccaattttactcttttaaaaaaatcttatttcaaccggacacatttttatacagtataaaaacatgttaaaaatcagcagttacagaagcggttaagaacttccttgtgaaagcaatgttcactcagtctttattttccaaatgacttgaatgctcttaatactaatttcaccttgatctaagccactttatattaaacccttttatttaaagttagttgcttttgagcccactgcatagagaccctctaattctgtgtagtgacttgtactttagtgcccaattagagtgtgaatcaaggttaattagcaacaaatcatctttttataattgaagaatctaaggtacagcaagataagtgacctactgagggacagagttcaaaataaaataggtttcagtcactcaatgaagtgctttgctgggagatctcgcctggtcctgtggtcctttagtgaaatatggggaaaccagcaggggacgtaggtcagatagtttataatggtgagttataggttgtatattataaggagcatttctcagcactgaagaaatttcactagattccagctcacctttccaaactattaaaagcaaaacgggactgtttttcaaaaattggaaagtaaacctggcttcttgttagaaatttggaaaatattgagaagttttagacccagtccctttaaccttaaggagctcacatgcaataagatggaaggggcaggggagatcaggacagaaaactaccgatatggccgtgagagcatggaagcttagatcagtgaattcttcttgaatttacctttttataaatctttaaaaacaaatttgactttaaaaaagcacaaatataaatcggaaatgctaattagcacgttaagttagatgaaacatatcagtggaatcaaagctcacgcgtcaaatgatgtattttaatattttaaaaatcacagtttaagctggacatagtggctcacacctgtaatcccagcactttgggaggccaaggtaggtagatcacttgagctcaggagttcaagaccagcctggacaacatggtgaaaccctgtctgtacaaaaaatacaaaaattagctgggtatggtggtgcctgcctgtagtcccagctactcaggaggctgaggcgggagcatagcttgagagaaggttaaaggctgcataagccatgattgcaccactgcactccagcctggataacagagtgagaacctatctccaaaaaaaaaaaaaaaaaaaaaaaaaaatatatatatatatatacacacacacacacactatatatatatatatatataaactatatatatatataaactatatatatatataaactatatatatatataaactatatatatatataaactatatatatatataaactatatatatatataaactatatatatatatatagttagtttaagaaatgagcaaaaatgaatagctaggcagaaatttatgatagcttttcttagattaaacaccaaaaatatcttgaacatttgcgttggctgaaaatgttctttgtaaacagtgaaaaaaatctacagttttattttaaaaaagaattagttatgtttcctagtactttcacattgaattaatttgtcacttattctagtggataaacaagaatagggctacttacctgaatgttaatggggcagatgctaccagagccaacccttatccccaggacctttcacatttctcttgtgaactttctactgtcagcacctgcatctcaaatgctgatttgcccatggacagcagttcattctagggaattaatatgcttgcttttccagcagccctcatctaataactctctagaggtgacatataaatactccagctccctcaccctcagatgagataattctgaagctgtgttttgcactagttctgaaagcttccccagggaattcagctccaagcacccactctggcagctgatttattagatgcttttccttctttgtctctcttccccacttccctaccactgttccctacttggggtctgcttctggagaacccatactaaatcctaaaattaggcattattgttattacacttctatgcactacctggattaaccccatggcgatcatcgtttgggaattctcaagtgttttacataaaaggcatcattcataaagctaaagaaggaccagtaggatcaatgacgcacactaatggattgaaagagttatctagcatgacccgagatgcattagcaaacacaggaaatctgaccttgggagaaagcccctgatctgagcctggagagtaagactgaagtcagaatgataagccttccttgtccaatgtcacattgctttggatttgctgtagagctggaggttcagggaagggcatttctgcaatgccttcttttacttttgcatgtccttcctggcctgactgatgtgggcggtgatctcattttattctttctccctaaatcttctacagcagtatacacatagatagtgaatacttgttgattaatgggctactgtgctgtgctgtcaggtgctatattaaattctgttatagcagttacttctaggatctgtaggtattttttttttttgtactataagtccgctggtctttgttgctattacattatggagcattgtcaaatattccattttctcttcgaggagtacttggcaaaattagcatctgatgatttatttttgaaaattagtgataagatattgatgaaatagacatagtttctaatcttttgtttctagtcccatttagttctgtgcatgatcttgtgaatgagaactttcatatgctaaggaaatctcttccagccttaaccaggagcaatcaagccagttgttgctgacacatccctgctacacctcgcttctctggctgtggtttgctgggatccccagggtagtagttagatgaacactgccatcatcttgcctactctgctccaggatttctagcgtggctcactgtccccaaccagacgtccttatcagcaattccttagagatgtcactctgactcttgtggtgatctcacagaaatactcataaaaaaaattgagtatgctgctgtgtgctgtaaattgtctttctcaacttgaagttatacctctttaaccactgttcatcatttctgtgacaactgtatgagtatactgtatactttaaacatgacaatgattgatcctgtaggtaaaataccaaatggttgaaaacaaatggcaaggatttttacaattgaaaggcctatccacccggtgaccactgtattattcattagaaataggtattatcttagctattataactgctggaagttttgtgaaccttttatgtccagtcaaaactgcaaactctgcatatgcttgcttatgaatattacttctagctaaagaagtgttcatatagtcttttccatttaaatacatggctaggcatttactgaaatgtgagctatttactaatggtagattactgcagtgtctttcatatcagatgttgcttatctgacaatctcaactaggtggaaactaggcaagaaacaggtaggaagctgaattggctcgtgagataacctaagagatatcccagtgtctatgcagtacctattcttgtgtactttatctttattcactggaaaacccttctacaaccacatgcaaaatcagtttgtttttaaaaaattttacactttttttttaaagacaggattttgctttcttacccaggctggagtgcagtggcacgatcatagctgactggagcctcatctcctgggcgcaagtgatcctcccacctcagcctcccaagtaggtgggactagagatgcatgtcaccatgcctggctaattgaatttttttttttttttagtagagataaggtctcgctttttttttttagtagagataagttcacttgaactcctagattcaagtgatccacccacctcagcctcccaaagagctgggattacaggcatgagccaccatacctggcctttacacatacttttaacaggtttggttcagttatataatttcctggttagtagcaaacaagaagggagaaaagaatagactaccagagaaaaatactaagaaattatactttattaatacctaaatgattaaacttagtgaaagagtgagttttagtcacattttaacttaaaaactgataattgtgttagaaagcttcagacagtttgagtgcctgttatacgctgagcaatgcaatgcaatgtttaccagagtcctctctagctcttacatcttgtctgtgagacagacattattattgccattttaaaaattagagaacaacttaggctctgatgagtgaaatgatttgcacaaggccaagcagtaagtaactgagtttgaattaaaaccaggactgtccgatttaaaggccctattgtttctatcatatcaaattgcttccacatgggccattccacaatgtacttagtgaaattattattttaagagcaatacacttcttagaggaacttaataataacctcctctgactcccctgaatttacgtatctttttcttttttttttgcctaaatggggatataaacaaaaatagtgattattttgatttatatttacataataactttttcactttgtatagattcagtttgtgactctaataatactatttctggcttcaggcctgttgatgttcgactcatgcagtcacatacttgttctttaaatggttgtggtgaggatcatgtgaaggaaggaacagccagaaaagcatcaagataattgtgacaactgccacgggtggtacagtgattaaagagaacagatatgtaaaagtaatttctttgctgagccatcactggtgcagagagcaaaacaatggggacagatgtgactgaaagaagttttgatgttatcctagtgtttggttttaatccctcctcacctcttgacaccatcaatttttatctgtcatgtaaaaacagcagcaacagctcatagtagaaggtatgctgcaacggtaaatttcatggcaagacttcttacgtaattcagggatcacatgaaagaaaaccacaacattatcttctagcttcttatctgattttgtaaaaaggtttcaagcatactttttttttccataagtgttatttatcagaaatcttaaatggtagaaaccaaactttgtgaaacaggaagggtaataaagattcccgtgtatctgggcggccacgaagcatcatggagtttttgttttgtgtctccgtggagttaactggttttagcagttctactgaactttagctaaaatgaattacacaaataactgattagaattgactcatgctagaatttgaattactaaagcatgcagaaataagagtaaatgctaaggggagctttgctgcttttagggtgtttgatgtgaattctgatctggtctcctactaccttcaatctatttgataccacagtacaagggacactcaggtacatgtaggctccaaacccttatctagtcacatcttcatgagccacactgacctttttaacatagaatgtaggttagaggcctatggttcgtttttgtggcgttaagagtcccacccacccaagacccagtgaatgagaatctcttggtgtagggactagagatggacattttaactattcttcctgggtgagtctgatgcatatttgggaacctctgcacaggcctcctaagtatcattaccccttctaaatatgtggcatctctaccctcagagagtgttaccatatttgttagcgggaagggaagagagaaaagtgtcaggcttgaacagaagagaactttgaacatctattcaaagagtggaaaactttgaacctctttattctactacccatacctccaagtccagctgccttggtataattatatttcttgaatatgcacattttcctttgagctcgaatagaactgcttctccttggatgtggaattgatgtgagtagataggagtgacgctcttccttagagctgagattcttactactggggggaaaagagaccaggctgcccctattccttatcacactcccttaccctgatcattccaattcactatatctgataccatccgtgattcagatgctcacctcgggagaggagctgtttttctggatattaaactacatgagcaagagtgaacattttgtattgtgtaaaattccgtgtttgggatggtgttagaggcagagatacttcctgggtctaatgccatacagagaggcttgatacttaccctcaagcaggaatgagaggtacatttaaattactagactgattagactcctgaatttagaatcctaatttaaactcctgaagagttagctgagggatgtgaggggcctgtacagttgcagacacatctgtttcaccccaaacagatcctgtactgtttggagagaaacccctagtcttccctacatccctggctttagattttttggggcctgttcttagaatgaggttcataagggaaggggcagtgtggccctcctgagaccagagggaataggataaggcagaagttctcaagtgttgaaacgcctgaggttcttggtaaaatgcagattccagacccccacctggatccactgaggggagtgccttagtttcctagggctgctgtaacaaattaccacacccttgttggcttaaaacggaaattcattttctcatggttttggaggccagaaatctgaaatcagggtgtcagcaaggggtggttccttctggaggctctgagggagaattcgttctatgcctgtctcctagttttggtgactgtgggaaatccttggcattccttggcttataataacatcgtaccccaaacaatacaaaacaaaaataacaaaataccacctaaattaagttaggtgcactccttagtgtccccctccctgagtgctttgagtaaatctctaattttgctttgattgctctggttaacacacaaccataagaacacgaccagcactgcaacactcacctatctgacaaggacacctgtgctttcccctttacaccctctacaaagggacttggaggctctctaataaacccaaggacatgctttctgtgggaaagaagtgggggcaggtacttagctcctgggactcctggtgaatggctagtttgttcagctgtgctgtcactttgttgctgtagacactaaattccagtctggattacaaaccttttgtgagtaactcggactaatatttacaatgctggaagatgtaaaatttaaaaagccagttgacctgaaataatttgttagttttctcccccctggcctaatccaagagctttctgcttagctcatcaggtcctctggtgaccttaatttacttttaggtagcaaatttcctgttccatgcaagcagaggaagttctctcaatgaaatatagccaaatcagcacaataccaatcacctatcctattaatttctttatactaagtctggaaggcatttagggccttgaatctctttgcctgcctgtgtcctccctctttctcatttgtaatccgtctgttttccccattaaactgtaggcatcaatgccaaccataagttttataccaaacatatgattggcatcccttccttggaggcactgtaccctaatggttaagggctgtgccacagatccatgactgtattcagctctaccatttactagattgtgatcataggcaagttattgaactgctctaagcttcatttttcccatctgatgaatgggggcaatgatgacaatgatcatgatacccactttattggatgattgagagaattagattatgtaagttttataaagggcttggtacacaataaattctcaattagctatttttgtgattacaattgtaattatattattattatttgtttaaaatgccagtaagataagcttgagtaaaagatttcttatactaggaaagaagacaataactacaggatgacaggctgagtaaaattatttgcataataacccacattgattaggctcttagtaggcattagcacaatccaaagttcttacatctatgatcttatttgatcatcatggcatgctaagaactattactattaccttattttcctgatgagataactgaagcacagagagattaagtatcttgttcaaagtttgtcagcgttaacaagggtctaagatttaccacacactatgttatagtcactccactggcttcaaaagattaatatagggaaggtttctaaattgctcatttttataatataattattcaacatgtttatgtgtattcaatacaaattgtttactataacattattcaaaaaactttctattaatacacatatcacaaacacatgttcctttagggtgggggtaaaaagccccagcatcttagcttctaggtgggagcctgcaggcacggagtgctctttttctctctggtggttgcataggttacagagccagcaggaagtccagtgcctgtggccagtagaggaatagcatggaccctgcagagagactgtcatcaagctgtgctgggcaggttcttacactttgtggcggggaactttcttgctgggagaggttcttctgggctgtggctgctcacagccatgctataattggcttctgcaaagtagcaagcatgctggctttgctacccccatccatctggctgagttttatgcacatgcaaataacagaacccttatttgtggctatccctgggactcatgagtcacaacgcatgcatccatacggtctacaatgtcatacagccaaagctgggggtggggattagaacatttagattcagccagtctgactttattgtctctgtgcctcaccaatatatcaggccaccttcctccaataggaaaatcctaaaaaagtcctgacattggtgtctcaatctttgccagatttttggcacaccacaatctgagcttaaattgcgatgcaaaatatttcggacaaggctcagcattgctacttgtttgtttgcttattttttgttggaaacccagtgtagttcatttcatctccacactcagctgttcactgatagcttttcttcttaaaggaaatattttttagtacttgttgatgttgactttagtaacgcaatattatcaatagtatttagaatggttctttaacaaaaatgtaatttcaaagcaaccttatgaaattttacttataagtttttcattttatagcacttgctctgggaaatggctacttgtcaaaataatgacggattcaaatctcaatggcgtgtagtcacatttccatagtaaatatgcagtcacaagtcctttctggtatttcaaattttcccacttttttaacatcaacttactgatataaattctattttctttagattatttttgaatattgcaatttgaaggctgatgaaattatcttcgttatagaaaaaagtaactttaaaaattataatatagtttagaagctttggaatatgtagataaacaaaaagaaaataaaaataattaataatctcatcatccagagatagccgttgttaaaatttgttttttataatgaaatgattttttaaaatttactgcttattgcaggaaaatatactgacagaaaattaaattatctgtttacactaaccttgatagatttctttaaaaagaagcccaagtcctccaaactatttaaaagtaagcaaataaacactttatttgaaattttaaaaggtgaaaaagcacaaattaaatattaagtttgatacacaggtgttttagatttagattgtttatgatttaatagacttttgtgttatgtagcataattttttgttgggattcaatttgcatatggtacactaaggtttcttatgcattgatagcatatagtatattttatgcttgttttctagggtttgcagtgtaattttatctatttaactttataatagtcaaaacaaccaaaatgttctttaatagtaggatagataactaatagtttacataatgaaatactatgcagtgatgaaaatgagtgaactatagccatgttcaacaacatggataaatctcacagccataatactgaatgaaagaaaccagatgcaaaataatacatatactcaggccaggagcaatggttcatgactgtaatcccagcactttaggaggccgaggtgggcggatcatttgaggtcaggattttgagaccagcctggccaacatggtgaaaccccatctccactaaaaatacaaaaactagctgggtgtggtggtgtgcacctgtagtcccagctgctcgggaggctgaggcaggaggatcacttgaacccaggaggtggaagttgcagtgagccaagatcacaccactgtactccagtttgggtgacagagggacactccatctcaaaaaaaaatactgtattaatgtatttatgtaaagttcaaaaatagatataactaaactatagatgggataaggacagtcaggaaattataatacagttaggaatttaggacatttgttgcttttgaaaggaggaagagggtagtgattgggaaaggcaggaaggaacatctagggtactcaaaatgatctatttgttgacctggttgatggctagtaaggtgcactcgcttttaaaaagaccgcattgagcttcctttatattttgtgtactttgctgtgtgtgtgatatacttcagtataaaaagctaaataattactacagaagtcatatttatttgatatctactctttgctcccgacataacacccaatcttcctgttatttcctcagggaaatatggtttgctttactgtcatggtttccaaggatgcattaggcttaaaaaaaaaaaccgtagaactgctaccatttgttttgtctctattgtgataaaatttccaagtcatttacatattttctagatagttgatacattttattagttcttgttcccagcagatgtgtgagacaggctggtattgcagtccctattgttcagataaggaaagtagacacagggagagtaaatgtttggctgagcctggaattgaaatgcagttcttttaacattcctctgtgctgtctgactatataacactgctacagtcatagataactcagaatttccccaaaacttggactcccagagaaaaaagatttccatgaacacgaataggcactaactataaaaacatttttgtagatgaaatttacatttgtatctaagaagtatggttaagcacattgaggggagttactcactgattcaacaaacgtttctgagcattgggtattgtgcctgcctctgcaggagatggagctaggaatattactataacacaaacgtgataagtgaaataatagagaatcccacagtgttttgtggaaaatattggcccagaagaggggctggtaacgagcttcttagaaaagaagcatttggaaggtcttttggaggaggggatcccggaatctaatctgaaatatacagggatgcattttattttatgtaaaacttgataggtcagttagatttcctacatttttcccctcataatattttgacctcccaattttaagaaactttgtattcttagagaacattttttttttgaaatttaaagaacagattgaatttccagagatggcaactggatggtaaactccttgaagataggacatcttatactaccttgttttttttccagggtccagttgcataatagcctgttcattaagattattgcaggattgtttttggagggggctatttttggtagaagtgagttcttcattttaatactacacttgccttctttgtcagtgaatctaaagtgctgagctgttagatttgaggttgttcagatattttatttcagctgaattctaacatcatcaagtcttgcatatcaaaatccatttacaaataaattcaactgagctgcatacagcctgttggtggtattaatttttaaaaataggttatgctatagattttatttataggcatttagatgagcgtaaagctctaaggcagcaaaatcccatgtacaatactgatgccagcataggccacttttcaaggttgacatttttgtttttcagatatgatgtgtgcatcatcttattctttatgtgaggttcaatagatgatcccttgtttgtaaacagaggtcaggcctaaccaaatttcagcaaagaaattcagttacagaaagagaatgtaataacatcaaaacctttatgtggaaacggtattttgcatttcctgatagacatatcctggcatctctgatgacatccactaaggtggttctctaaaatattttataattgctgatgagtcattaggtaatatggagaaaatgccttagatcctttctcttttttatgagaggaatgcctgggaaaataaatgaaagttcaagtgggagacagcagaacattagtgataaaggaagcaacatgaggggcctgtgtttataagggcttttaaagttaattataccattaaaaaaatttgtgaaatgtaaaatattggcccatagtataggatagttgtgggaaatatctcctggaagtgatactctcatagtgtgccacttttccgcatcatcttaacatttgtaataacctaatgatggaaaggaaaaagcacttatggtccagaaataaaaagaaataatatattttaccaagtgaatggtaaactattcttagccaattagtagcctaatgatctgcccaggcctgactggtttaaaatgatggtaattctaaaatataaacaattgcttaaatatatgtcaaaaagaaaggaaatgaacgcaagtccactgccttaatttcttagagcaaatcctaaaataaatgttttgggaggttagaataaatgaaataaaaatgaaattaccgtagttttgtaacagagttctcaaatgagggcctttggatgtactttttcagggggtcctcaaacctcttaaaattgtgtgcaaatgtagtaaatcaaagccatttttcaggagtaagtaggtcctacacttttatcaggttctcaacagttaagaaccattgattaaaccaattcctagtgtgtgttagttagagacagtgggtaaatagttgggaaatataacaagcctgtgaaatatgcctatgtatatggtaacaaagatgaaaggaggctatatttctgggaatgcaataaaatggtatctatgttattaaaatgtttgcatagagaactttattcttttgttgagatgcaaaacttttatttccctctgtactatgttgccttgtcctgcaaacagacaatgagaaataacattctccatgattagagctgtgcttagatcagaagtttggacattctgtttatttttctttagttatcacactttgcttgtaccacatcacagattgaataatgaacaaagcaagggtggcctggtagcagcaagcatttgacttgttactgaaaatgagcttactggactttgaattggttacttcatatccccaagaacaatttgcttccccaagaacaaaatgctatgtacattttgctttttgttaagagcaaggtcaactgtgattaaagtcagcctatcttttggaatatgaatgcattttaaatggatttccattttctaggatacataagcaagatattcctcaagtcaatgggggatgaaagtgctccagaaattatctgtgatcctggatctgtggaaaactgtgtgtgtgtgcatgtgtgtgtgtgtatacaaagttcattgaacaaagtataatagaaaagtagtgtctaccttaggatcaaattgaagtttccacaccattttttcaccctcgtttgactaggctctcacagtggtctccaagattgtgcattatcaggttgggggagggagagtcaaggaaatattttactctgttctttttccatagtttccctgagctctcaaactggcagccagctggctgaagcctgcccacagacatgttttatttggcccatgcagtgcttttacaatgtttgtgccaacattttaataggaagatttcacatatggatctgcatttctgcattgtcttgagaaatcagaagacatgggaataactggctggagctgaggggcagttgtcttcctcccgctggggcacagcttccttctgcagttccttccatgacttcatgtgctcacacccagcccaagcagttatttacctgcttgactgctggaggcagtttgagattggcttaaggctgcctttgagattgccttagtcttctgattaataaccaggttttgtataaagctatcttcttggtcccagagagccttattacttaataatacatagatatctgaccatcaaatctaataattttcaggttcaaaggatttggaatttctaatttgggcttgaagttggcaaggagtgcaaataaaagagaacacaaatgcctaaaatgcttatctgtccttacaaacattcaatttctgttgtgtatcagagctggtctgaagctgtaattacagtagtgctgtaactaacttgtgcttgctggttctggaatttgatgataaaaaatggattttttttggccttaagacaaagagttgattgattaaaaaggcattatggtatatgtagacttctaggatgttatgatttctttatgctttggacaaaaccctgaggaaaatttaatagatttgggttgtctctttaatttgtgaggctgtaaatttctaattttaaatgttcaattattttggtcaggataaagggctgtgcaaattcagatagtcttcctttccaattgttccaaacaaccctttctggttatggataaatctccttgccaaaactcatattcaacttgttggagggctagcctttatctttctgcctaaggtctttggaagccatttttaatcccactaaattctgcagtttgattaagatagagtggctgaaacaaggtatttagtaatatcatgaatgtgaaggtaattagtatttaatgtccaaaagagaaaaataaaagcttgccagtgtgctaacttggaacgattatatttctttcgaaacaattttgttttcacatactgctagcctagcaatgaattagaatgcataaaagctcaggggatttgaatgtgggaatggataaatgttttataatgaggtagagaattattgcccaaccttagaaataaaagctacataaaattatgaatgtccagatcaatagcattttttaatattataaatcacttttggcagtgcttatgtatgagcagagcagtgatctaatgattatgaaattagattttttttccctctctctctttttctcttctatttttttcctcatagaggcagccgaaggactttgggtaaaccactataacttgctacatttccccaacagtgaaatttttagaaatatgtttgaatgttctgagtacagactatattacttctgtgatttttttaggctgaccagaggtgacatctatttttatgtgaaaagtaaaaatgagatgatctgaaagagttaattttgataactgcttttttactttttaagtaattttattgttttacttgtcttcaggtgttctaagacacaatggaaaacataagaaaaaatgaatttcctttcctggactataaggaaaaaggcaatctactccaaaagaaatgagaagatgcttcgttaggattttatctagcacatctagagtctagaatgaacaacattatgtataggagaaaagtggaatatttatagttttttgttttttaaagagatgaaatctcactgaaggttctttataaagctccattatgggaagaatcacctggacagatgttcagaataaagtcatcatggtcaaaagcaaacatttaccaatgcatgacagtttttgtcttcttttaggcagttgccttacctttattagtgcctgacaatttgctagttagaataaaaccataccttatgctggtttattgctttaaaattatgcccatctgaaaatgtctaaatgtgcagaaatgtaccttttaaaggttagtcaatgtgaatttagagctgtagggaatttaggttgctaggggactctgtggttctccttcagaattgttaaaaaattctctgccagcctgtgagctccctgagggcaggcactgtgctcatctctgtagtatctcctactcctaacacagttcttggcatgtagtatatgctcacttttcttatctaactgacaagtgaaggggtaatcagctgctagtgtttctgttgctaatatgtgacggtttcagcaccttgcgaggcaagtgtgcgactttgggagaaacagaggttaaccaaacaatcttgcaaattaatgtaaaattcctgcttcactaatcagatttttatctctgttatagggggacagccctcttagttttgtgagcagagcatagtttgtgaaagagcccatggttttcaggcccaggtggtgtttcttttgaattcttaggcatctagtttggactagcttcatggtttttgccatatactgctctgtattggagcagtctgtctggaagaaggaacagtgctctgtgtgtgtgtgtgtgtgagctagtttttagtatcccctctgctactgcccatgtgaccttggcaactcacttaacctctaggcctcagagttatcatgctaagattgggatttataactgctatggcccctttaaacttcagtatgctgtttgaatgcatgttttagtgcttttattagtctgtatgttcttatgcagctttttggtgtgtgttttaaaaaactttttattatagataactttgaccacacacaaaagcagacagatcagtaatatgaacctgcaagcattcatcacccagctccaacaatcaatccatcaactcatggccaattctgccccattctgccccatcctcttactctccttattatctggaagcaaatcttagatacttgttatttaatctgtaaatattttgtatttatatgttttctcacctctcaggcaggcacctaacatagaacctcgtatacattaggaaacaagatgatggttttgaataaatgaatgagagtgggttgggaaaggtaagagatgaggcacctcaccccccaccccaaattataaatatttaaaacattttaaaaattgttaacctatagttcctcagggcagtggagggggaggagccaaggcttccagttattgggaatcctaatttggtgtggaatattaaagggcaactttatctattacatgtaatcactgtatcaccagggagccccagcatgttccaagaagttaaggtacatgccaaagataagcaaaaaaaggcatgcaaccctatgggtgcatcttgaggaaatatattagcattaggagatagcacaacctaaaggccaaactgtgttcatctaatttaatgggaatttaaaaatttatgggaaggacttgacacttgatgcttctctttattttatactttctattacctgttttctaaacattttttatccttcacaatagtctcttttccttctttcttttcttttcattattttcccaacaatgctaaagcactcaagggagttttgttgagcactgaattatgtgtaatatattttagccaaagtatgcatacttactttggatgtattactcccaaatgtataggcaacatagtctgcataccacaaataaaataaaaacaagaataaaaaattctaagtaaaaaactttcctttatgcactaaaagtatttggtaagactgttaaaagcagcattatgtacagtaaatataaaactgcaaatatatactatatgtatacttataaggtatagcaaatataaaacttcaaataatctaaatatcctttaacaacagaatggataagtggaatactatgcactagttaaaaataataaactatggctacctgcaacattatggacgtattttacagacataatgttaagtgagagattatatgttgcactattccatttacatcaggttcaaaaacaggtgaaatcaatctgtggaatcagaagtcaggataatggttaacttgatgggggagtaggtgatgacgggacagagcttgagagaggattctagacattgcagatgttctatatcttgagttgggtggtggctacacagttgtgctcattttgtaaaattttatcaagctgttcatttaagatctatgtacttcacagtatgtaattatatttaaatgaaaaagtaaaaggaaaaaatccttccttttgattacttaggaacacctaaagtttaaacctattgtcagcctgaccatataaaaaataagacttgccttactaatcagattttctctgttgtatgggagatagacctggtagactgaggaagaagttatagacacacgaagtttttactgtacaaagtatttgtttctctgcctcgtgggataataatcatcaataaactgtgaaatgattgttacaataaagtactagttggatacatcagtgttggcagctgtggaaaacttattattttcctacagggtgcataattaatgggtcatgtaagggaaggtcctgactcagggttggagtatgtattatacttgccaaaggagtatgacaagaggacttcagaatgaagttcagcatatatttagttgcaagagcaactatacatataagtagtattttaatacaatggaaataaacctagggctgaattgataggtgaatacagtaaaaaatgtattgcctttagaaaagggtaaaggaagtgatactcacatgatataaatagtaacacttttagataggagataattcttccttatatcaagttgagtaggactattttgggtatcatgtgcagaacttgtcctagataggattttgctactgggaacatttggctctggtgccttttttcttctctttgttttaagtacagaatggtatcatatgagaacaaaacacgaactttggagttagactgctattagttcaaatcttgtctctatcttaagttgtttgactttggcaagtaacttctctgacactaattttttcatatttaaaatgggggttctacctaactgggatatttaatagatatatcaatctatctttgtgtcaggactcaaaataactgtaaacacacagtaatttattccacttaaaagaagtccagagatagacggtctagcaccggtacatctgcttcctgaaatgaccagcaacttaggctccatttaaactcttcaatctgccattctcagcacgagttctatcctcaaagtggatgttggagctccaagccatcttcctcattccagacagctggaagaaagatggggcatagggcaaaaagtttagctcccagttgagttctctctcttttagttgtcctagaagtcctgtacaatacttccattttgtttcttattggctagaatttagcaatataacctcacgtagcaacagaaggaggctgggaaatgtagtcttttagctggaataaaaatggggattggttactaaggaagaagtggaaagtgattttggctgtcagccaggaatctcagacacgatgttctcaacaaaactcttcatggcccctctccttagcaaattctatcactatccaccagatagatagctcactctgaaaatttgaggttcattcaccaatccttttttcccttcattccccatatgcaaattagcagcaatcccacaattctaaaatacatcctgaaatcggaaccctctatcactactattaaatccacaatttaaatcaccatcatctcttatctggattctttcagttacctcctgattaattccctgcttcttgtgttgctttccacagatcactgcctgcatagcaaacagaatgatttcctaaaaaaaaaaaattgagactgtattgttcccttgcttaaagccctccaacagcttcccattgcaataaaaataaatgtcaccttcttatttggcctataaggcctgacgtggtttggctcctgcctctgtaaactcatcatctaccccttgtccccaggttctcatgctccagccacagtggctaccttcctgtcccgcgaatgtacccagtatatactacctcagacttttgctctggaacattcgttctcatttttgcatggctaaccctttctgaattagtcagggttctccatagaaagataatcaattggttttttatatttttaaggagattttattatggagaattagcatatgcaaatatggagaccacaatgtgccatctacaagctggagacccaagacagctggtggtgtaattcagtctgagtccgaaggctgagagccagaggaactgatggtgtgaatcccagtctgaaggcaagggaagatgaaatgagatttcccagctcaagtggtgagacaagaaacagagaaggggggacaaattcctctttcttccatgttttgttctattcaaaatggattggctgatgcccacagtggggagggcaatatgttttaccgagtccactgattccaatgctaatctcatccggaaaccctcacaaacacacccagaaacgatgtttaatctggacatcccatgcaaggtcccgtcaagttgacacaaaaattaaccatcacactttcccgcagtttgggtttcagctcaaacatttttccctcagataggccttctctgaccatctttctaacttcatgtccaagacatcctttgtttcgctatctaattatatttgattcagggcttgacatgtgcttccaccctgctcctctaaatagacaaaaattttggccatgtgctgaattgaccacggtgtggaggaagacatattctcctgcatcatcagtggggaatgcatgcattggctaaaaacctctttagagggcacttgtacagtatccattagaactaaaactatagcttcatgagggaaagagactatggccatagtaggagttcagtaacttgttgaaagaatggtgaatttgaagattaaatcacagagtatctgattccagttctttttaacttcctttttttctccatagctttcatcccatatttaaaatgtcctctgctaagatgccaacacatatcctttaaagtaaaattcctagctgggagcagtggctcacgcctgtaatcccagcattttgggaggctgaggcgggcggatcacttgaggttaggagttcaagaccagcttgaccaatatggtgaaaccttgtctctactaaaaatacaaaaattagctgggtgtggtggtacgtgcctgtagtcccagttactcaggaggctgaggcaggagaattgcttgaacccgggaggtggaggttgcagtgagccgaggtcacaccattgcactccagcctgggcaacagaatgagactctgtctcaaaaaaaaaaaaaaaaaaaaaaaaaaaaaaaaaaaaaaaaagtaaaattcttcaaataggtgcatcccagttcctgggggcaaggcctcaaaataaacctagtgcatctccctggattgtcagtttatttgaaggtttgtggaaaaaaaaattatcagattgtcagtttatttgaaggtttgtggaaaaaaaaattatcagaaagagtatggacatattaaaaatgtgagggcctttcgatctactttctaggtccctgggggaacaagctcagtgtctttgacactaagggctatttgatgaagtttgaaaagcaccatttaaaggtcttagctcttgggtggatatttgcattttgatagagaattcttcaatccatcataaagttttcttttgaggaattatgcttactgggtttagctcggggcagtaggtgctggatcaatcaaaagtcttcccgaaatgctagtgataaagcaatatccaggaagccttaggtttttatattctgttattctcttcagtttgcaagctgctttaacatacattattttatctaattggctcctcacatcaaccaagttgagtatagccatgcaaagaattaaacacttcaaacaatattacattttaaaataacttaaatgtaattccctagagacctgcatccttagttccattctctaaaggggaatttcttgcgtatctttccagacatattttattaagcatataccatctcagatctttgggtgtgatctccatgtatatttttcataggcaaatgaggagtaaactacaatatattctgctttttaaaaaaagcatactgttttacattggagtgtagtgttttattgtatgaagtaccccaaattcagttaattctgagggaggggagacatttgagttgtcttcagtattttgctgtaatagctgatgctcttaggaacatcttttacaagatgatcatttttttctttgctcacataaataaaataaataacaaattccaaggagaggaattgctgtgtttaaggctgtgtttagttctgctaaatattgtaaaatcgccctcaaaaaacttttaacacatgcactccccactgatggtatatgagagtaactttttcctataccatggtcaattcggtatatgaaaaattttgatcttattttaaaatattgttgatttgtataaatttcagaggtacaagcacagttatgttacatgaatatattggtaatcgtgaaatctgggcttttagtgtagccatcacccatactttgtacccattaagtaatttctcatgcctcattccctcccaccattccgagtctccagtgtctattatttcatactctatgtacaagcacatgaacaatttaaaaagttttgttaataagatagggaaaaggcctggctcagttgctcatgcctgtaattccagcactttgggaggctgaggatcacttgagctcaggagttcgagaccagcctgggcaacatagtgagaccctgtctctaccaaaaattaagtgcggtggtgtgtggctctggtcccaggtacttgggaggctgaagtagggggattgtttgagcctggaaggttgaagctgcagtgagctgtgattgtgccactggactctagcctgggcgacagtgagacactgtctgaaaaaaaaaaaggaaaaaatcttatttttactagcggtcatttaattgagattgagcattttccccccaagtgtttcaaagctattagcaataattttttttgtgtgtaaactctctggttgtatttctcacctaacttcattgaattgttggtctttttcttttcttttttttaatttgtaaagattcctcatatgttaaagataggtaattaaccctttctgccatatgtgtttcaaatatttgttcccagttaattgttatggtgtttatgagcaaccgtctacattaaattaggtgaaagtgggcttcattagaaacattaagggcttatgaactggcagaacagcatggagagagagcaagaaattgagagaaaaggtcagaggttgagtcatggagctggggctttctagctttatgatcctggacaatcacttaatgtcaggagacctcagtttcctcaactatagagtgaggataattacaatacttcctcatagagtcataaagatttagtgacatcatgcatgttaaagtgctctatacataagactaagtgaatattagtttttattactgaactatcttgcatattggaatacaatacttcaggaaatagaaatttctgtcttcaattattttttgaaagacaaaactaatttttatatttcagatgtttttctgctgttagcatatctcatgattcctgctgattccataattaaggaagacaaatttctttctaatattggaattagaaataaaagatatgattattaaatgctaatgagtaataaaggattatatgatactagtattgaaaagtaaattaattatattaaaatgataaggctaaatcttatttcctttttcaaaatgtcagtggaaaaatttgctaaaatgcagttcttttatttgcagtttttttagatcataaaaatagaatgttttcagttttgtatatgtgtaaagtgaatgtgtagaattagagctttaaaaatttttgatctggaaacaacctagacatcatctagccccgggcttgtttttacagatgaggaagtgagaaattccgagaagcatagtgactagtgagtcatgtggccattgcagaacaaaagggaagaaattttctgtctcctgtctcccagtgtagggcccctttcactgtcctatgtcatttggatgcataggttgcatttctgctacatgtttggggtttatgacactagctatactccttaaacttgttaaatgaacagccatggttttctagcctagagggaaataagttgtactcaaactctgctcttttggagatatgattttgagctgctttaaccaaaaaaaaacaggctttaaaagctcttcctatacttctgcttacactgagttttaatattctgtcaaacattttaaacttttttctccgatttacttcaggttttcatagagtaaggacattttagaagaacccaagaagcaaatatgttcaagtttttaggctacaccaacacacattttttctgttgatattcaagcataatatatatttaaagcattcaaagttgatccaaactataataaaatcctagcatggctagcaaatttatttcagtttttttttcttgcaaatcttagttttgtttgtgttttaggctaaatgttaaaattaaggaaataaataccaataaattgacatgttcttcctgtggttggtgtgattttaattttaatttatttttctttaagctatcttgagttcatgtaaaatattaattgaaatgaaagttgcttgtaggtttcttatatagtataagaaaaaagactagagatatccctccacctccccattcatctttcttatagcagaagcagtgccccaatttggtgatagtaagagaaggtcattgacatcagcttgcatacgcagctttggtatcatgctaaatagaataagacagtatttaataaattcatcttggacagtgaacactttgaaaggtgagagaagagccaacagggaaggtgaaatgagtttggaagctgattttcacaactgaaaaaattgacaacagatagtttctttatgctgaaactaattggtattgtcaaaattgagctatatcatttccactggaagccacagttcttattagaaaagtgttatgagataagatatttaaggctatttaaatattcgtatgaatcccagacagtaggaggaacagttgtgagagccagttgctaaggacaacccatttcctactttcttcttctccctcttagcagcaacaccaacctttggatcactgccaacctttggaaatccctgtccttggaaggagaataaatgaagccatcatttactgtaacagcatttattccctaagcatttaaaatgggaaaagctttaaaatgtaaaaaagatatacatgcttattatacaaaattcaaattaagaaataaagaagagaataaatgttattcataaacctaccacccagagataaccaccgttaacattttggtgtatattctccaggatcattatagacttatgctgcaattggcttttttatttttttgctatatatatatatatatatacacacacacatatacgtatatatgcatatgtacgtatatatgtatacgtatgtatatatacatatatacacatatatatgtatatatgtatatatatatttgctatatatgtgtatatatacatatatgcatatatatatgcacgcatatatatgtgtatatatacatatatgcatatatatatgcacgcatatatatgtgtatctatatatcctgggtatccttccaatcaataaataatcaatgtcatttttaatgaatgcatattccactggatggttgtactgtaattaatttaggtagattccaaaggatagagttttaggttgcttcaaaagttttttttttttacttagtataagtaatgctatagtaaatcagcaactattgaacacctactctgtcaaggatgtgctaggtgttggagatacagagatacatagcatgcatctcctacatttaggtactgaaagaggaaacaggcatggaaacatgtaattgcaatactgtgtgaggtggacaacaacagagccacatataggcccatgttcacactaaggatggagtgaccccttctgtgtggttacactgagaaatttgaccaaggatgagacagtcttaaagcataagcagttgtttcccaagaatcacctgggagagtgattaagattgctccatcccagttctgtctcccagagagcatgattcagaaggtcaagggtggggcctcaggtggtcctgttgttgcaggtgacctgctcttgacactttgagaaacagacattgggcgtgtgaaggggctaaggtggaattggaaaggggattattgccagatactggaggagcttgactgtcatactgagggctttagattttttttttttttttgataggtgaagtcattgaaggttttgaatgtcatgattagaactgtgtttgagataagctaatctgacagggagagtattatggaaatgttttcccagcttcttgtgcagaggtaatacatttttgttttgctggttatttttatcaacaataaatcaaactaagtgctggccgggcagtgttcagtgcttcccaaacttgaatgtgcttatgaattacctggaatcttgtgaaaatatacattcctacttgatagttcagggttaggatctgagattctgcctttctaacaagctcctaaatgatgttgagggccctaatctgtgcactacacaggagtagatgtgccaaaggagggtttttgattaaatgagaatttccactttattctttacacgtgagtgtgctttatgatcttaagacttcaggaagctcactttgcgatctgttatggtaatatccctaacaaagttctacttccgttgacccctttctctgtgcaaataacatcctgtttactcacgatttactatgtgaaagcttcaatgcagagccaaccaatacatacataactcagagccaattttctagttaagtcttaagtgttttcataaaactgaaaaatgcggctgggtgcggtggcaggtaagggaataggtggagagaaagggaagggcctagggaggagaacgtgagaactccaaaggaaacagtaatgctgtgcttcctaaactgactgtctgatcctaactgactgtctgattcctaaactgagtgtctgatcctaaattgaatgcctggtttggagtccagtgtgttttcatctcagcatgcaaatttaaacccaaagaaagttaggtgcttaaatgctctagggtagctgggctttaagtggctacttatcatagtgtttatttgaatgttagagaaatagcttcaagcaacagaaggcttgacttagagtggtttaaacaaatagggatttaatgtttttgtataattagaagctggcggtagacagatgtttgttttgttgttcttctttgtacctttgtacctttcacatatctaatgagtatttatgtaattaataactaaaacaatgtttaaagattgtttttggaccaggtatggtggctcacacctgtaatcccagcactttgggaggctgaggtgggcggatcacgaggtcaggagttcgagatcagcctgatcaacatggtgaaaccctgtctctactaaaaatacaaaaattagctgggtgtgtggtggcacgcgcctgtagtcccagctactcaggaggctgaggcaggagaatcgcttgaacccgggaggggaaggttggagtgagctgagatcgcgccactgcactccagcctgggcaagagaccatctcaaaacaaaacaaaaaacaacaaaaaaacctgaaaaacgcttttgagtaggaggaactttcacagaataagaggtttgaagttagttaactgtattgagttacaaagccaccattgcttatttcttggtatagttgttccttaatcaaatttcttaatcagatataaccaacagatgaattataaagcagaatttggaatatctgtaactttagagtacctcttttgtctgccttcactacatatatactgtctcttattagatttgaacctttttgcttcaaagtagattctgtgtgttggctagaaagcataaatatcctttagggaagaatacttaaaaaaccagtatcttgtgtagtgttcttgagtaaattcagtgccatagtatatttgttgtcagatttgggagtgagataggtggcaactaaatatatatacagggagcataatacattcaaggagtatacaacttttacattcctatagcacgttagggtttattcaaagtgaggtccttcatttgaccctcagaacagtcatgtgaaataggcagcacaggcatcattacaaatgtgactttacaaatgtgagaaggctgaggctcagagaagtgaaatgatttggctaaggtcaaaagcaagtcacagtgaatgcctggtctggagtccggtgtgttttcatctcagcatgcaaatttaaacccaaagaaagttaggtgcttaaatgctctagggtagctgggctttacgtggctacttaccatagtgtttatttgaatgttagagaaatagcttcaagcaacagaaggcttgacttagagtggtttaaacaaatagggatttaatgtttttgtataattagaagctggaggtaggcagttgctagtgctgattctgctgttcagagacccaggctctttgactttttgctctgccgttttgcatatgttgactttcgttctcaggcttgtctcctcctacttgccaaggtggctgccctagctctgggagaagggtgatggagtgtgtgtgcagtaaggggtggggggtagtgccagcctcatctgtctctcttatcaggaaaagaaaaagctgcccagaaattccaccagctgacttctatttaagtcatattggccagagagttggtacatgtcatcttgtctatcccctgtccatgccccgttcctgccttatgaaaaggcagggaaagtgaatatttagctttgtcaaccttaaaagtagaggcaggcaagggagacaggtggttgacaataggtgttgagtgagccagcctacagtgcctgtcacagtcttaccgtaattctatttggagcaaatagcattggataaacattgagtgcacatcctcatagtttcctgccactgatgaattttgtgattattgcttctgagtgctaggcagctcttttctgctcacttctggggaaagtcaaatttaaagaactataattacatgggagaagagaaggggtgctggattcttaatagttctttgtcagtataactagctcatttttttttgggtgcaatagttacacatctaccttatcatcctttgtaaatgtttattttatgcatgcatgtaaattagttaagaattggaattaaactgtggccgcttgtcttaagaatggtgtaggatcagcaagccttggattgtgtgtgtttgcctagagctgagtgtttttatgaagaagcaaaaacctattcatgagtgtatttaaagctgcagccaagtgacgatgtatattctgtttctcaggtaagtgaaatgtaaagagaagttttggagtcagatggacttgtgctataatcctgggtcacctcctgaaccatggtccctccttttccaagtgaggataggggattcatgacatggcacatggctggcagcaccacagagctgggctaacttcactgtgttttaactctctttctttctagttctttgttttccatacaacaccatggcttgttgaacttggaagctgtttatctatttcccttgataaaaaggtttagtttttgtttcttacagaaaggggaagtaatttaaaagtgttggcccagtggacttcccttttgattaaatacacagcaattatgtttaataaaagagatacaagtgccagataaaattgtcataagttatcactttggagagagcatactctctaccaagaataaaagtgctccctcaaaatggaatccactgacatctctccccatcctccattcgtctccatttcacttcagtaaaccatcttgagtcagagaaagtaaaaggtgccattctagagccattttgaaaggaaaatattaattaagatgtgtgcatctaagagaagaatataggtaaataaaagatcaatcatttttatttttctttttgttatatattttacatatatatacatataaagcaaatttccatatgtagaaattcatgtaattcttaatgaagtcaaggagcgctactttcctgacgtagttgcttttgtgatatttataaagcaggttgtaaaatataagtatatactactatcattttgggttgctagttataatgaagaattcagaacatttatatatatgtactttaaatagtgtgctctggaaacagtttttttgcatacacatttggtaaataatcaagaagcatttccatgataagttggatcttgccatactagggccatttgtgtttattagaagcaaaatgtggaacttcgcaatttagtgttgtagaatgatcatgagaatcaacattaacatgtgaaatatgggccttgagttagaagccttgaaggagaatggaacacatcagtgaagctctaaggcctgttggttttgaagcttattggaaccataccctgcaattcctgttgaactgatcatctttcgattatactgtcatgtataatgatgtggggttttttttggtaattgctgtcctcattcaacattatatattattctttgttttaggggctaaaatgcatttttggaatgcctggctgagattagaattatacatttgagagacagaagaaagcaaactacttcttaacaaaattgaacctgtaactttgacctagtagtctcaggctttcactgaactaaatgaggcagattataaactgtgtattgtttagtggagactttatgttctgttaatactctgaattttaaattgttgtatagattattctatctagtgtacaaattaataccaaattccgtattaattcaagtataattgtactttacaaactcttagcttaaaaacagttttcattatgtgacatgtcagaaatatgcataagtaagtagagtagtataaataaaaaacaaagagcatcctagagcaaagccctatgtgcccatctctcagcttcaacaattctcaactcatggtttcccttgtttcacctgctcctctttccactctcttctttttccaatctggaatcatatcatttttattttatccataaatatttcagcatatgactctaaaagataaagactaatctccagtattaaacagtttgaaatggctattttatatggtagatgtgtaaaatgtgagaatggtgcttaacatcaggcataataaattgcagatcgacgtggttttggtacatgtctgcgttcaagctcattttctataagccaccagttttgctgcttaaagtttggtaatctttgtttacatgcaatttagttaaaatgctaaaagagttttgcatttgctttcctttcattggtggcttttttccagatagaatttgttttgtgtccacagagtgattggtctctgttttacatgaaaatgttatctctaagaatggttccatgtggccactgatgattctccagttgtgcttttctgtcttaaaattaccctctgtattttagagcagatagaaagaagataaaaacccctaaatttgagatttggggtttatgacagacatgtcattttcattagaaaactatatactgcttttagtattttgtgattaagccaaacagtatagttgaacatttccataatgatacctttggggatagaagtatgactccttcttcttcttcttcttcttcttcttcttcttcttcttcttcttcttcttcttcttcttcttcttcttcttcttcttcttcttcttcttctccttctccttcttctttcttcttcctcttcttcctcttcttcttcctccttcttcctcttcctcttcttttttgtttaacttgttatatgttgtatctagttgtgctgaaatagaggatttaatttgcagattaatatgtaaggatgtacattataatgaatttgcattattgtagaagacaatggaggcaatatagagtgtttgtggttcatagtgtggcttctgaggccataccgtcagggtttggctacctgctctaccaactaatagccatagtgtcttggctaagtcacagaacttctaaaatccttagttttcttatctaaaatatcagaataataagggtacctaacttatttttttaatatgcattaaatgagaaaaaaacaaacaaaaattattgtttgctttaattaataagatatttatttgttaatgaacatttttaatgctgtaattacttgtttagtgaccaaaaacataaagattgctggtttctggatgtcaggtgaatatgcattaaaggatttaagtgttaaagcattaagaggcaaatttgttattctgaggtctggtagctactaaatattttatatgagaattttcacatatgtcagatctgtgatccattcagctctagtatcgcatatccaatgttacctcaagaagcatgtgacaggagctgaaactgatttttgttatgtcagaagtggccctagtttacctgaaatcccatttggattcatgatcatgaattcattaaaagttcttatgctacagttgtattttcagtttgtgccatatattatagtaataagttccacaggctcaccatctccgtgtagagaagccacgcattttagctaaaaggcgtctgtccagtttgagaaggtacagctgagctgagttgtagtcttctggcatttgttcccttgcagactgggactaattagatctttctgattggcagggctggatgtcctgatctgaacaccaagtgtagttagttcaaatttcaggtcttggctaactctatgagttcttgggggccttcttgccttaactatgccatgaggtaggttactgggctcaagggtcttgatagatcagaggacagtggaatgctctgaaccaggaaagcaagtactgaaatggaaatcagaaagacacctacctgcttcatgaagttgccagatcccgttcttgggctctgtgaacttatagcttgtcattctctaagtgtactttgttttatttttatcaggttggcatttcacaccccaaagatgcttaatgtgtcatttgcaaaatttgaaacatcagattactcagtctcttctagtccatttataaaatgtactgcaaggctgatcttggcatcatgcccaagagaaccctcatgttttgcccttcttctatctgacaagtacctgttcatccttaactttgtgctctgttcctagttttgtcttcctgatagaacatttttacaatacttataatttattaatataaatgtgtgtgtgtatgtatttcctagtttctttagtccttgactcaaataccctgtgttcgaacctgaactctgatgcttgcaaattggtcatactcaccttttcagcctctgtttcctcaattgtagcataaggataataatagtatttacttcgaaaagttgttgtatacactgcatactgcactgtagagcattcagcacagtacctgccgttcgataaagactcacacaatattactggttttcttattgccatcacctcaatgacataggctgtctttaaccaaagtaacagcatatttctgtctcctttttgttgtattcctgtttgatcttcaatattcattgagtgtctagtatacaactcaagtactgttttccagacactgggaatagtgttaaacaaaacagattctctgctctcatggaatttacaatccagtggaggagaatgagagcacataaataagaataatgatgctagtgattaagtatcgtgaagaatttttagacacatatttcataatttacatatatttaggttgtcatttcatttacttagacagactaaggataagaataagaataagactttggaggaaatgaattactatcacacaaagtcattttcacatctaggatgctttagagccagaaaatggttttgtccatctgtcactgtctgaatacctactggtactcagcaattaattcaagaggacagtgtagtttagattattttgtttcatgtgacaatttctatttggaaagtaatttaaataatagtagaaggtttatgaaccttaattaaatgaagtcttcagctagtataatctgatgggctatagagttttctaactatccattgctattccttaaccagactaagaaggattctgcctcagggccttggcacatgagttctttctttcttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccacatgagttctttctaccaagaatgttcttcctgtagacttttgtaaggtttgctaccccactctgcccttcaccatgctacctaagctagtactttcctcacagcactttctagtcccatacctgcctcacttttctttatagcacttaacacctcctgacatacatgtgtttattgtttgtccccaccactaaaatgtaagctctttgagagcagtaatttgtgtgttttgatcactgctgtatttccagcacttagaagagtgagtacatatagtaagtggccaataaatattcactaactgaataaatacatgcaagacagcttaccaactttacagaggaaatattttagaatctattaagtaggacagtaaattctaagtttaggtgaaatggagctaaagatcatgattgttttcataagaggagtcagaaatagtgattaagatggaatggaatggactgagaagaaataaagtgaatcttgggaaaattaagaaaagaataagaaaacagaatttaatgttgtatatttaaatatattgtccaagagtataaatattcagaaacatttgagtgcagaagatgctgtgggtctcaccaatgtgtgaaagaatagtccttggacctcgggatcattgtctaacttagccctagtacaaaatccctggagaatctgggcaaaataaattgaacacttgacttctcatttcagtttttattactacctcttagtcttttgtgctcttactgttaagttgttttcactcaactaattatttattgtatgtttacaaagtgaaagggttgtcataaataatgttttttcaaaacaagaaaaaaatgctaacttttgacaagcagtaaaatctaagggcttttctggagggtttttcttggaagatgcaagagtaagttgtttggagtggaagtcccattcctacctcaaggctttcctgtctacagtgatttttcttcaaagattgtaagtgttttgtttaagcctttgttgccagtctctcccttactcaactttacttcctgggattttgaaaaaaatctctaaactagggaaacagaaaaatggattaggtacatacacattgagaagtgatgtcttttgggatcgaatttgtgactagctgataatttactcaataataaagatatgtgtttctaaagtgtacccctttcatgataagggctacagacaatagaagtgaagctttttcgaatcagaatccagaatcagtatatgaggagacttttaatctactttattcatcattactcagtacaggttgagtgcttattttgtgtaagacattataaggcataggaagttaactaagaaatgaggaatttataatctagcagaaaaggcaaaaatatacaatctttttgatacaggtcagtactgtaataaataaataaaataaaagctggtgagatgcacaggacaaagggatcactaccagtaaagattcagaaaaggcaagaggcagtaagtgggatttctgttggatcttgcatgagattttccgatgaagtaggatgacaatatatcatgagcagaggcatagagatcgaatattatgggtcacgttcaggcaacagcaatgttccagaagagacagaaggggagccagcgtggaaagtgtaccttaagaaggaaggatatttccaactgagagagagagaggaagcagagaccgagaggataaagattcagagcaatttgaagtgaagacatcaaggagtttctttcaaagcttcaagctcattagatttgggagcaaagttattcattgaaaggaggcagatgagagttatcttcagatcacttattccaataagtttacttcagaaaaatatgtcttgagaggttaggtgcctttccagcttgatacaaaaaactagaatccaggtcctctcatttcgactccaagtgttctttcttgcccaaagtcaaaattccctaaagacctatataccaaaatagtttcctatgttaagcacttcttatcaaacaagtaactttgatctatgcacatgaaatgcaggctagaaaagaaatcatataaaccctcataaactcttatttttagagggaaaaaaggagatttgttgctttcagttaaatgaaaataacagaagcactatgtgtcaaacaaggatggcatactggctgtggctccagagactgttggggcactgagcagccccattttctgcattacgacccttttgtgggcctgatacgcagctatcctaggacagccaaggaagggaattctgggcttgttgctcttgtgaatctatagaccctggaatggatatagttccaaccaatgtcttagttttagttaatttcatgggtttttcagaaccagaagttaggtactcagagtggtttccggtcattcatgctacttggtcatccaagtaattgttggactttaggcagcatggcaagtttgggtttggcagctgtcagtcccaagtgtgaacgtgacattggatcattgatgtcacaggaggacatcaaggagaacaaagagctacagctatacaggaaaaagtttgaggagaaaatattttcctgttttttatctctggaataggcagttccctaatagttttgtaggctaatggattgtttgcccagatataaaagtgaacatactggtatgaagaacaggatgaacttaccactcttggcatttaaaaatgacaaatgccaggcttttccatgtgcatacatgtgtatgctgagactaaaactctccttgagaaaaccctgggacagcatatggggagttctgggaatgaacttctctgattctaagtgagctgagagtcttcacaagagctggagtgtcttgggcttcagagatttcccagcccaggttttcagttacaagctttagtttcagagacagatctcagcatccagctcaggagagtgctgattctgcactcctgttactattgatacactgtacaaaatatatgtttaaaatctgttgatacagttcatgagattttacaaatatggggcatttaacctaaacaaaacatttatggaaagtaccaaaaataaattttggtccatcagtgagccaacaggtgttagcgtgttttgatactaccatttttccccttaatattagcctttgttagttaggcgaaaccacgataattccccagcccaaggttgggaacctttcttaaggatcatataataaatgttttaggattttcagaacatatgatctctattgctactacttaccactagctactgttgtaaaagcagccacagacactatgcaaacgcatggatttgcttatgtttcaataaaactttatttataaaagcagctgatgagccccagtttgcctactcctgctctagtccaatgcctgtattttactaaaataaatctcagaggaatatctggctaaaggttacacagtttcaggcttgggacaaaaatctatgtatcttcctttttactccatttaaatttttttttttttttttttttttttttttttttgagacggagtctcgctttgtcgcccaggctggagtgcagtggcgagatctcggctcactgcaagctcctcctcccgggttcacgccattctcctacctcagtctcctgagtagccgggactacaggtgcccgccaccacgcccagctatttttttttttttttttttttttttttgtatttttagtagagacagggtttcaccgtgttagccgggatggtctcgatctcctgacctcgtgatctgcccgcctcagcctcccaaagtgctgggattacaggcgtgagccacagtgcccggcctttttttttttttttttgagacaaagtctcgctcttgtcgaccaggctggagtgcaatggtgcgatctcggctcactgcaatctccgcctcctgggttcaagcgattcacctgcctcagcctcccgagtagctgggattacaggcatgtaccaccacacccaactaatttttgtatttttagtagagacggtgtttcaccatgttggccaggctggtctcgaactcctggccttaggcgatctgcccacctcggcctcccaaagtgctgggattacaggcgtgagccaccatacctggcccaaaaacaatctttaaacattgttttaggtattaattacataaatactcattagatatgtgaaaggtgcaaagaagaataaaacaaacatctggtgtgaacatcagacagtcagtttaggaagcagagcattactgtttcctttggagttctgcatgttctcctccctaggcccttccctttctctccacttcagaggtattcccttaactgaattttgggttctttattccgttgtttttcttcatggtctcatctcatgtacttgtattctttttgcagggtttaaaaagtcgttcccttagatggttttatttcatttcttttgtattagaaagtttagaaaaaggcagtaaaatttggcttaatggatagtcacagatttcctttattggttttttcttggcaatacactgagcaggcccaggaagtcggagtagggtgcctacagtatatgactttaactcatttcatggcctattcttgggtttcttgtgccatcacagagtgtcatgggctgacagacgagtgtaggagtttagtggctttctactcccaccccacttcctgaggaaatagttgtggtaaatcagggctgtttctagggatggcaaggtatattggtctgacagtgattttatctttgaactaaatgcatatgataatatgtgcataattctgttaattagaaaaaaatttttgaagaaaaattttgtttgttgcatataataaaaatttcaatcttaagaataatatttagtcaattatcaaaagtattattagctctaatatttatgaatatcacatatgtaaatattagatcttagaatgtgatttagatggacacattccttgctttgtaggtagccaaaacttttttagcatctaatttttcagggcatgccataggtgactctgataaagcattttgttgtcttcttgcacaaatgcttcattttttttctccttttttaattttaaaattcttttattatactttaagttctgggataaatgtgcagaatgtgcaggtttgttacataggtatacatgtgccatggtggtttgctgtacccatcaacccgtcatccaggttttaagccccacatgcattaggtatttctcctaatgctatccctcccctagcaccctatcccccaataggccccagtgtgtgatgttcccctccctgtgtccatgtgttctcattgttcaactcacacttatgagtgagaacacgcagtgttcagttttctgttcctgtgttagtttgctgaaaatgatggtttccagcttcatccatgtccctgcaaaggacatgaactcattcttttttatggctgcatagtattccatgctgtatatgtgccacattttctttatctagtctatgattgatgggcatttgggttggttccaagtctttgctattgtaaatagtgctgcagtaagcatacatgtgcatgtgtctttataatagaatgatttataatcctttgggtatatacccagtaatgggattgctgggtcaaatggtatttctggttctagatccttgagaaatcgccatactgtcttccaccaacagtgtaaaagcgttcctatttctccacagccttgccagcatctgttgtttcctaacttcctaataatcgccattctaactggcgtgagatggtatctcattgtggttttgatttgcatttctctaatgaccactgatgatgagctttttttcatatgtttgttggctgcataaatgtcttcttttgagaagtgtctgttcatatccttcacctactttttgatggggttgtttttttcttgtaaatttgtttaagttctttgtagattctggatattagccctttgtcagatggatagattgcaaaaattttctcccaatctgtaggtagcctgttcactctgatgatagtttcttttgctgtgcagaagctctttagtttaattagatcccatttgtcaattttggcttttgttgcaattgctttggtgttttagtcatgacgtctttccccatgcctatgtcctgaatggtattgcctaggttttcttctagcgtttttatggtttcaggtcttacgtttaagtctttaatccatcttgagttaatttttgtgtaaggtgtaaggaaggggcccagtttcagttttctgaatgccagttttcccaatgccatttatcaaatagggaatcctttccctattgctttttttttttgtcaggtttgtcaaagatcagatggttgtagatgtgtggtgttatttctgagttctctgttctgttctattggtctatatctctgttttggtaccagtactatgctgttgtggttcctgtagccttgtagtatagtttgaagtcaggtagcatgatgcctccagctttgttctttttgcttaggattgtcttggctatactggctcttctttggttccatgttaagtttaaactagttttttctaattctgtgaagaaagtcaatggtatcttgatgggaatagcatcgaatctataaattactttgggcagtaaggccattttcacgatgttgattcttcctatccatgagcatggaatgtttttccatttgtttgtgtcgtctcttatttccttgaacagtggtttgtagttcttcttgaagaggtccttcacatcccttgtaagttgtattcctgggtatttttattctgtttgtagcaattgtgaatgggagttcactcatgatttggctctctgtttgtctgttattggtgtataggaatgcttgtgatttttacacatttattttgtatcctgagactttgctgaagttgcttatcagctgaaggagtttttgggctgagatgctggggttttctaaatatacaatcatgttatctgcaaacagagacagagagacatggaacatgtctcaaaataataagagctatttatgacaaacccacagccaacatcataccgaatgggcaaaagctggaaggattccctttgaaaatcagcacaagacaaggatgccctctcttaccactcctattcaacatagtattggaagttctggccagggcaatcaggcaagagaaagaaataaaagatattcaaatagtcttttttctttttctttctttttttttttgacagtgtcttgctctgtcacccaggctgaagtgcagtggtgtgatcttggctcactgcaacctctgacttctgtattcaagccattctcctgcctcagccacctgagtagctgggactacaggcctgtgctaccacgcctggctaacttttgtatttttagtggagacggggtttcacatattggccaggctggtcttgaactcctaatctcaagtgatctacctgcctaactcagtgtaggttgttcctcagggatagtgaaaagtttgagctgatccattcagatacctttaccttcagttactttgggaagtaattggttgctgggttatttctgaccatggcatgggatgaaaagaactgccatgagaggttggcactgtgttccagtatctctctcaattgtctcaaaatatttttcaaatttcaattccaattgtaactaccctagtgcataatttcatattttgattacttcaattcagtaccttcttgtctggccttcttgcctctttttcaatggttctcagttctggctgcacattgaaatcacctgagagctaaactgctaatgcctggtctatcccacagagatttgtatttaattggtctggggcacagcttgagaatattaaaatcaccttacattctaagtactctctagatgattctaatgagcagctaaggttgagggccactgctcttgtacaagagggtcatcttttttaacctatcatctgacgtgagtgatatttgagagggagaatggataagacttgggaagtgatcacatatttagcatgagaaagaagatgagtataagacattgcataggctttgagcttttgcaatggatggatgaaggtgccttttactgagatagcaaaaatagacatgctgcttaagagaaaaaataaggatttagttttgaacgagagaatttgagcaacccatggggaaatccctttgaaaatcacaattgttaggaaatatcagtgctgactagaaataaaataggaatgtattctctattgctaaaaatagtaaagaatccctgccaggtgcttaactttcgcttacatatttctagcaaaagagaatgaattactcattctatctttgggcagctaaaatagtttgaaggttcttccttatattgaccccgcatctgccttgctcctaacctctgtccagtgatccttttgatgtctttggagttattcacaacaagtctactttctcttccatgagatagtcttcaagcctcagaagaaatttactctcaagtgttctcttccttgggcccatggccaccaggtcctcatttaatatgcttgcaataaccatactttctaactcatcttcttatcaagtcagctaaacataaatgttaatgaaataccttagacccgataagcatttcctaatcatgtctttatttaatgacatttaatatcctaacttaaaaaaacctcatgatatatttgcagtatagaagaggtgatattgtctgaaataatgctcttcttttttcttttatactccattatatatttttaaaaattacatttaaaaatagaaaatgtgtgtaaaaatactttatattttgttgaataaaatattcttataattgatttaagaattagctcaacatggtcaagtatttgattgttttgtttcaagattgatgataatggttatttaaaagtctgtaaagttatagaagagaggagtcactcaaggaccaaacacgagactcatgctatttctcttgcagaagatttaatcttcaaggataaatgcggcattcagtttcccactgctgctagtccagaaggtatgcacacatttggataactgagctcccttttcttcccttggaaactgttttgagctcggaatttgttgtttagatcatgatttcatacgtcagaggattggaagtctcctttaggtacttggcagagccaggacatttttccatatatagctggaaaaacctttcttgcccattctggtttgaaagaatgttattaaaagttcattcctgctttcttttctttttctctttttttttttccttttttgctaaggaacagaagtgggcactaaaaattcgtgcctggaagaactaagacttgctccaacatagaggactggctgcgtgttctgagaacctcccctaggtgttctcggtcattccctttatagcactcacaggcacatctgtgggtggcaattattgattccttcctggcccacttcctcctcatggctctgggaagccccacaggctgactttgcagagatgaatcaaggcagtggctaatctcctgagtcatggccagaggctctttggttactctctgaagatgggatctgtttacctcagagttccctctctgagggtatttggaattttggatggtggcctggaattctggagagtggagttctctagggaaaagttgtgctggtagcagtcggcttataaagtttatgctgtctgccctttgataagggtcataggatgtagtaaatattctttgggaaaataaaaagtccagtggaccctcaattctggctttgcaggtactgtgacctccaggcatcagtgtagggaaatgggaagtgagctctctttgaatctctccttcatctgcacctattgtggttctactcagatttcaagctgatcttcaagtgagagtgaggcagactttgtttgaatctttgactttggtcaaagtgtggcgctttggtcaagttaacttgcttatttggacttgctttcttcatctgtaaactggggttaaccatgcctattgcacagggatttaggtgaggattaaatgagattaggtgggttaatgtatacaagatggttagcatatcttcttaggaaagcaagtgtttttagtgaaaaggagatggattttggaaccattcatacttcatttccctggtggatctcttctttcctagctgcacgattgatcactgaagatgcccaagcattttgttctgtaacctttggtttcatcttctgtaaaactgtaccattctcagaggactgttttaagatttaagtggaccatcttgtcctacttgggcaggaattagtagacactcaacaaatattagctcaccttctccaagggctttacccaagccctccttttaccccacgaccatctcagagatgattgctccttttcttgccctttcaggttttttgtttgtttatttttgtttatcagctcacctcaatatctgggtgagaaactctgtttcttactgcacatcagtctcttctctacttgatggtcaattgctttgaagcagaatcttcatcctattcatctctgttctcacaggcttctgatatcaaaccatattcctttattcccggcaacccgaaaatatcccctttcccctcaattcccttaaacttgaattccaggttaattcagagttaatttcttaaccttttctgcctgactcaaatatcctgcaataaatgatgtgagaagtaaatagcttagtgttcaatgtaacgcatattacatttagtatttacttcaaaataaaataacttgtgtttctattattgttctataaaatgtaagagggaagctagaataaagatgatctagaagtggaagctttatattttgatataaaattaatggacaggatgtttatttaaagtaaactaagcctgaacacattgtgaaatgaatcacaatccagaatgttgatattttgggtataatacaccttattcaaaaactccaaaagcacactgattcagtcatcttttaataatactttagttttgggaggctgaggcgggcagatcacttgagctcacaagtttgagaccagcctgggcaacatggggaaaccccatctcgacaaaaatacaaaaattagctggttgcttgcctctttagtcccagctactctggaggctgaggtgggaggatcaactgagcctgggtaggctgaggctgcagtgagctgtgatagtaccactgagctccagcctgggtgacagagtgtgaccctgtctcaaaaaataaataaataaataaataaaataaaaaataaagtttagcaatttagaaaagaaaatatttttttcttgattttcggatattcccttttatatttgagggaatatctgaaaatcaagttttctccaagaatagaaaaaataatcaggtttgcttcagaaattatggtttaaatattaattagaactgcataaaatattgtactttatttacctttggaagatcaccctttgcttccaggcattaagagtatgaattaggccaggatttgggagttgctaatactgttaattattcccctcttttccttctcttgtttctttagcttcctgtccaatttgtgaggaatgcctaataccctgagtctggcacctgaacacttttagcatataatattcactaggataatagatcaagagttttcagtaaaaacattgggcatttgctcagtgacctgcaacatagcctgtgccttttgtcccgagttccagtttatgctgcccttgagtccctgtcagaacacagggagaaacattcccgaccccctggaaagcattccttgcatgcataggagtctctggaaagttatacttttgaagaaaatggagagagccgctaccacttcatacatcttaatgcttccaggattattttctaatgccagtccctttagacctccttaaaaatacatttgagtcacagcattggacacttccacagggaacactgaatctatattaactgccttagctatcacacgaggtgatggctgggaagaaggtgctgtctggaatccatcaacttggttttctgactaggcaagaaaaatgaaaagcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggaatataaatcttgctgctataaagacacatgcacacgtatgtttattgcggcattattcacaatagcaaagacttggaaccaacccaaatgtcctacaatgatagactggattaagaaaatgtggcacatatacaccatggaatactatgcagccttaaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacacaggaaggggaatatcacactctggggaccgtggtggggtggggggtggggggaggggggagggatagcattgggagatatacctaatgctagatgacgagttagtgggtgcagcgcaccagcatggcacatgtatacatatgtaactaacctgcacaatgtgcacatgtaccctaaaacttacagtataataaaaaaaaattaaaaaaaaaaagaaaaatgaaaagctttctcttatgctggatcttcaaattttggtttggaaaatgccttctgactccaacaatgtaagctgaaatatgtagagataaaatgatgggaccaaagctgaaagtgtacattttggcttaatgaataggaaatgaatagcttcccctgtcacacgacttcatgggtgttctctctggaggcagaagtcacttttagttactaggaaaaaaagaaagtcaatgtgaaaacacttggaagatatccatgtatatgttaaacatatttggactccaagggccagtttgccaagttagagtcccgtatgctaatgaagttgctaattctagtctccaccaatgatattcagctgtgggaaaagactgcttcatcactaaagcctttttagcataaaatgcaagtaaaataatagcagcagcaaaaagcaaccagtttacaggggtgttgcaaactgacctaagccaatgtgtcatgagaaacgattaggttctttcaataaataacatttacccatagttagaggtgggcagaggttagctattccactacgcattcccctaccaggttacaataaaagcaagacttgatcaaatttcatcatacatacaatgtttagatatttttaggtaaacatttatcagacagcttgctttataaacttgaggaagtctcaaatgatcaaggaagaaatgctttgtctactcattgcatgaaagatttactcaaggcagtaagaatactctaggggaagaactcaattaactttttaccagaatcctccaaacctatggttggacacaaactatggtagtttagggttcagccttggaccccatggtggaggcaaagttttctctttccttttcataaaagggtagggaatgtcttggttttatatatatatatatatttaaacaattcacccatctcgaatatacattaattttgccagtgatagtccatttttaatatccattatactaattaatatgttactattttaatcaagaaaaactcatttctaacattcattgtgttaattagtaaagcctctggccagactagaaatagagagagttgaagcatttgtagtaaccactgatagtgtggtctttctgattaaatgttagctaaccatcccaggagtatggatccccaattagggtaactgaaacactttagggtatattaagttaatttacacattcgtaatgttggagcatttaagagtaaatcacagacatcatgacatgggtgtaaagaaaaagcaaaaagtgaatatctgatttatatggtagtgaaaatatataggtcctatttgctttcacattaaatttttatgttattttttttttttttgaaatggagttttgttcttgtagtccaggctggagtgcactggcacaatctcggctcacctcaacctctgcctcttgggttcaagtgattctcctgcctcagcctcctgaatagctggaactacaggtgcacgccaccacacccagctagtttttggtatttttagtagagacggggtttcacaatgttggccaggcttgtctcaaacttctgaccttgtgatttgcccgccttggcatcccaaagtgctgggattacagatgtgagccattgtgcccggccatatttttatgttaaaatagtcagcacatgaaagagatactgttaaacaactttatcaaatagcagtcctgtgtcgcagggtgatttattaaatcagttaagtcaataaacagttattgaatacctactgtgtgagggggttacagagatgagaggacacagttcttgtctttggctcactttaactgatgtaagtaggaccacaacataaggcaattgctgcacaatggaagggcgcaccatttattacaggtgaacaggaggctctgcaatagtggcctggaagggagtaacacagtgtctgagaagggcatgttgtttcctcataaataacctggaacatgattcatattgttggaattaagagttggataaagaagcatttatttaaaacgttgtcagggacatggagctcttcccaaggagccaaaataccatttagagttctagagatcctgcattcttgttttgactgcatgctctggacagtttgcagctcaggtaagaacaattccaacttccagatgagattagagcctagaaggggtttaatcttcaaatcatctgctaacttaaaaacaaaatttggaaacagtaatgattaacctgattaaagctgctctcaaggatcaaccagtaaaagaagtgatagcggtgtcaacaataccacataaagtagcaggatttgtatgtcagcagtcccatttttcaagatgccaagtctaaatctatttcctacccatatttaaatgaggagccagttttggaggaattttacttgtcaagtgtgaaagagaggaagagtcagaagacactctttccaagaattctgtggataaaaggagggtttttttttttaaaccaaacctcaaaattttactcttcagaaggagattttttttttttttgaagtccgatggcagcaggatgtgagattcccagttcagtggtgctgggagttaagcagaagaaggtggagatctttcttcttcatagcatgtgctcctttcacagaagcagcttgttaatcgtcaggaaggatttcagacaacctagtgatgatttccagctcaactgcttcccttccatgaggcaccgataccctatttgtgtgtgataaggtgatgatttccctttcatctcaaagctctgactcaagtggttggaggggcttggtgatgcgaaggctgagagagatacagagatgaaggatgatttctttaccaatgacacttctttaggtatctcagttgttattgtttctagaattagtataagatttttcagaggacaataggagaaatagctaagttagcatcagacaatataccagctttagttgctataactaagagcctggtaggcatatgtctgtgattgcttgtggtcatattagtgctgcaacttggagatgttgaaaccttcctttgtcctaaccattaaattcttgaggcaaagattgcctaattcttctctgtgttttacttggtaggagtacattttcagcattcagataacattattttgactacttatcagtaatttgtttcattccttttccacagataatatttgtttttggtagtttccaaaaatgactgatttggtgtttcaagtatttttaagcactgggaaagaatataagttgtttttagctttttatctttctagtttctaggcagtgtggatattccatactggttaagattataggctctggacttaaactctctggattcagtagtggctcagttactcactagctgtaaacatgggcaagtttcttaatgttctctagttttcagttttctcatttataaaacagagatactgatagtatttacatttagggttgttgtgaggaggaaagggaataatccatgctgtacacttatatatgtacaatgcagtccatgcaatggcacatagttagcactcaatatatatcatcatcatcatcatcttcattaccagcagctgcagcagtttagagaccaggacagagtcatggttaagagagcaggctttcagagaaggccaattcaaattgcataccagatactgcccaaaaataagagtgaagggaaaatcaaagatggactctgatgcccggtgcccagcaaaatgatgtaggctaaaaagttattacctgctcaaataaaaaatgggcaaaagaactgaacagatacctcactaaaaatatacatgatgacaagcatatggaaagatgtcatttttgtcattagggaattgcaaattagacaagattaggcatgttcaaggtagtatggctgtagatgagaattgcaaattaaacaacaataagaaaccactgtacacctattagaatggcaaaaatccaaaaaaactgacaataccaattgctggcaagaatgcagagcaaaaggaaccctcattcattgcttctgggaaaacaaaatggaacagccactttaaaagatagtttgacagtttcctacaaagctaaatatagtcttatcacaccagaaattgtactcctagttatttaccaaatggatttgaaaacttgtctacacaaaaacctacatgtgaatgttttgacagctttattaataatttctgaaaactagaaacaacaaaaatgtcctttaataggtgattagataaattgtggtatatcataaaataaaatattattcattgataaacagaaatagctatcaagccacaaaaagaaatggatgaatcttaaatgcatattgctaagtgaaaggctacatactctatggttccaattatatgatattctggaaaagtgactgtagtaatagtaaaactattagtggttgctggcagaggaagcagggttgagtaggtgaagtacagagaattttttagggtggtgatgctattttgtatgatattgtaattatggatatatgatactatgtatttgttaaaacccatagaactttatagtacacagagtgaaccttaatgtatgcaaatgaaaaaataatttaaggggttgggggatcctaggattgaatgcagaatgtgacaagacgataaaaggaaccaaggaaaaggaaccaaggctccttatgtaagtggatgattctaggactgggcaggagatgtacgcgatgaacctgtagtatcttgtagtgccatgaagtaaggaagagcttaaaacaaaacaataacaacaacaaacaaatccacaagaatgggttatatcaaagggacccaggagccaactgaaagagcttccaatggccaacactggaactgtttgagcaacaacataaagtagtactggaacctgccccaccgccaccccaaataaaatagatccgtgagtccatactgatataaagagtacagtgtggaaaggtgggttaaagtaactttacagtggagaaacccaacaaaaactagccaggtgagcaaggttaacctcaacagtgagaaatcatttgatagtatatattctctatacatacatatttatcacttgatatgataaaaatggcaccttacctctgttgtcttcctcctccaaacccataaccccagtctgatcatgagaaaaacatcagataaatcccagttcagggacatgttatataatacttgaccagtactcaaaactaataaggtaatcaaaaacaggaaaagaatgagaaactatcacagccgagaggagcctaaggcggagacatgtcaactaactgcagtgtggtttcctggatgagagcctggaacagaaagagggcgttaggcaaaaactaaggaaattagaagaaaatatggattttagttaatatatcagtaatagttcattaactataaaaacatgtaccataatatgtaagatataaataggagaaacggagtatggagtatataggaactctctgtactattttcattatttttctacagtctgatactgttctaaaaattaaagtttattataaaaaataatggtccatttaaaagaagatttttaacaagggtaaagttggccaggcacggtggctcatgcctgtaatcccagcactttgggaggttgaggcaggcagatagcttgagcccaggagtttgagaccagcctgagcaacatggcgaaactcaatctctgccaaaaaaatcccaaaaaacaaaaaacgaaaaattaaccaggtgaggtagcatgcacctgtagtcccagctactaggggagcctgaggtgggaggatcacttgagcttaggaggttgaggctgcagtgagctgtgattgcaccattgcactccagcctgggcaacagacggagaccctgtctctctctctctctctctctctctctctctccctcacacacacacatacacacacaaagtaaaataatgactcacatacagatataaaaattattatagtgttaaaagattttacttaattcataatgaaggaacaaggcagatgctacaactagtttaaagataaatccaaagatcagatatatttatagatcaaaaatattgaaatgaacatgcaaatggaggcaaaactagcttcttttgctgggaggaaagcaagtcagtttaacctccactggacaggacataatgtgcatgtctatagacaagaattgttttgtattgcaatcggttacctataatttatagagttgtaagacaacacccatagggtcagaatcagatacccagaaggatgttttctagacaatgtatagttttgtactgaagcacaaagattttcttacagggcatttacccacatgtcgtttactatcatgatgttttaacataactaaaaaaatcaaaatcaagatagttattggaagctccacctccttgacaattctaatgatgttcctgtgtcttcaaaacccccactcattgacttcctttatagttgtcattagttctgctccaaaatattttggctgtctgccttcctaacacagagtaagaatgcatttcctagcctctttgaagttaggcatatgacttgtaatcaccaatgatacaagagaggaagtgacttatgttctatccaggaggacattttaagggctggtacaaggtttgctacatttccttttcctgcctgcatgaatggggaaatatgtgtccaaatggagcttctgtatgcctgattctctgagtgactaagaagagcagagcactctcctgatgacctgtgttgaccttgaagcatgaatgagaaataaactcattgtattaagtctctggaagaaaatgacaagttcttagattgcttgggtttgaatcctggctacacaccatttactagttgtgtgatcttgggcaacttccctaacctctttgtgctttgatttccttatctggaaaatgagggtaataataatgcctagccatagggtggtcatgaaaatgaaataagatcatatatattgtcttctggcacaaagtcaatagcaactgggttattgtttatccattggtctttttgactctgcaactcaaaatttatcagtggtccgtcaaattaaacttttgaatatgaaacattaatcacaatgctgttcagaatggcacagctatttctgcaggggagagtgaaagggacagctgttccacagactgtctcagaatgctcattggaagacttgtgtgtatcatctttctctccagtgcttttgatgttgagtggtttgtgaaacatgaagaaactggacactaccatgtagcatgggatgctacatcagtgacaagcagaggacagagtgcctgaggaagactgagatttctttcttggaattggaaattattactatttttctagctcctttgaaatggtaacttcatattttgaaaaaattattaaccaaatggctgcttcattttattgtaacatttctgatgagtgaaacaattgaaattaatggaatgattgcaaaatagagtaagtatataataacatatgcaaaagtacctaaggttgcttgcataggtttatgctgctcaaattattatagttcttacagacagtgtctagtgtaaaaagatacacctgctgtggtcttgtgccctctgaagaatatatatagaactaagggtgaaatgacttggcatattttctataactttgttgcagctgttttccaaaagtgggcaaatatccagcattatttgcaagccaatgtaatgttctttgcaaaccatgaaagcctttcgtattttgatttatgagcaagttaatttcccagctcaatgagaaaggccatggagatgaaattgaatgtatacttatgcctttagtatctagtgattgtacagtcatgtgtcgctaacgacagggcattgttaggcgattttgtcatcatacaaacatcatagagtatactcacattgacagacttagacggtgtagcctattacacacctaggctacatgatacaacctattgctcctaggctacaaagaatgcagcatgttactgtactaaatactgtaggcaattataacacaatggtatttgtgcatctaaacatatctaaaaatagaaaagggacagtaaaaaatacagtattataatctgtcatatatgaggttggttgttgaacaaagcgttatgtggtacatgactgtatttcttctgaaaatttggtttatattgaatgatagcaaaccagcatctatcagttgctgagtgttacttataatggcatggaacctatgaaataggaaaacaagaggcacctctattaattaataggggtccttttcaaagtttcgggtgaaaaattactggttgtggtaagaatgtatgccttgattataaatattggcgtggaaaaatgtcctcatacttaattcaggcggatataagcttttatagttgaattaaataaatggataaaagttcaaaaaatacaaatcaaatttaaataaataaataaataagcatttctttacctaatacttggagaaacaagcatacctgtacttacccaccaaaatctctattttcatgacttaatttctatgcacactccactcttgttccacctctgtacctttgatcacaccgtctctctcacctgacatacacttctttgagtttaatgtacaacagaaactgcatatcttttctgaaatatcagaaaactgaaatccagttcacactgttatttctctcatcagaatttttacaactcttttactgggtatctcataatataacagtcatgaaaacttgtgttattatctttatatttaatgtttctatattttctccttttgtatttgggtggtgttagtgaaggaaagtgccctatctagcagaattctaggtacagatagagacaagtgcaggttgattgataaattcttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctccttacttcccagtaggggcagccgggcagaggcgcccctcacctcccggacggggcggctggccgggcagggggctgacccccccacccccccacctccctcccggacggggcggctggctgggcagaggggctcctcacttcccagtaggggcggccgggcagaggcgcccctcacctcccggacggggtggctggccgggcagggggctgacccccccacctccctcccggacggggcggctggccgggcagaggggctcctcacttcccagtaggggcggccgggcagaggcgcccctcacctcccagacggggcggctggccgggcggggggctgacccccccacctccctcccagatggggcggctggccgggcggggggctgacccccccacctccctcccggaccgggcggctggccgggcagaggggctcctcacttcccagtaggggcggccgggcagaggcgcccctcacctcccagacggggcggctggccgggcggagggctgacccccccacctccctaccggacggggcggctggccaggctgaggggctcctcacttcccagtaggggcggccgggcagaggcgcccctcacctcccggacggggcggctggccgggcggggggctgaccccccacctccctcccggatggggcggctggccgggcggggggctgaccccccccacctccctcccggacggggtggctgccgggcggagacgctcctcacttcccagatggggtggctgccgggtggagaggctcctcacttctcagacggggcagctgccggtcggagggtctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagagtcgctccccacatctcagacgatgggcggccgggcagagacgctcctcacttcctagatgtgatggcggctgggaagaggcgctcctcacttcctagatgggatggcggccgggcgcagacgctcctcactttccagactgggcagccaggcagagaggctcctcacatcccagacgatgggcggccaggcagagatgctcctcacttcccagacggggtggcggccgggcagaggctgcaatcttggcaccctgggaggccaaggcaggcggctgggaggtgtaggttgtagcgagccgagatcacgccattgcactccagcctgggcaccattgagcactgagtgaacgagactccgtctgcaatcccggcacctcgggaggccaaggctggcggatcactcgcggttaggggctggagaccggcccggccaacacagcgaaaccccgtctccaccaagaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagagggagagggagagggagagggagagggagagggagaggcccccttacatttttgcacgcaaggcaagtgcttcactagctttaccctagccgtaggcctgatctttgaaaatcaagaccttgtctctgctgcagcttcaatgtctttgttcctcctgagcaggctctgattgataaattcttaattgagagcagtcatatcacaaatacacaaacatcttttcaggtgaaccctccactggtattgacaatggagaaagctctgagaaattcacctttagatttgagttaatttgagttgtggtaaatcttagtaacaacaacaaacagtagcactaaaatgtatgtagatgcattaggctaagtattttatgtgtatcactctatttaatctttacaacaacccatgagcaatactattattattgatacagcactttatagaccagggaactgaagtacagagggctaaacttgtttaatgaagcgctcacagggtcgagaccggctccagttcactgttgagcactgtgcaggcctgcctgtcagcacagggagagcaacagttgaatttagcatccttcttatctgggggggtcatgagtaggaacgtattcattatattctgaggacttaagtggttgactgaaaacccagagcatttcaggtattacatctagagtttttaacgttacatttagatattacatttagggtttccataatatttgagaataatctagaactgatcatagaataaagtgaaaggaatgcaaatttctagctgattccctacccatttgttgaataaattcgggcaatcaaacaatctgaaatgtagcataatattatggctttggtttttaagatggaaaaagtgatttataaatgaacagattaagaatcagttttttacttttcctgatgggcttttgtggacactgttgtagttctcaataatcttgaatttatgaatgtgccggctaggaaattatcaacaccacatgctgtttcccacactgaaaacttttaagtattgagaaaaaaaatctgtatttatatgggtgataaagtgaaaaatataaaataaaattttcagagttgtgagggatttgtttatgtgctatagaagtatattggagaagttttaaaaactggttggttaaaaaaaatcagttagcttgaattttgagtggggtgtttcagttctagctagtggattgcttaatcatcaacattcagcttctgagaagaaatttcttcccaagtgaatacagtagactcttggctttcccagatttaacattttcagtttctattatttgggaatgaactttaagctcttcaatgtggtgatttgtaattgggtcaaatcataaatatgacagtgagaatgcaagactaatttgttggagccactcctagccaaggagaaagcctgtacccacatcttctcaagtgtgtatcttatggaggaaatcatatgttgtagtggtatttacaaaagcctgaggacatccatcataaatgttaatggtctgctagttgtacttaaactacaacttttctccatgcactcactaacactccctccctccctccctccctcagacctcctctacaccagagcctcctgccaaaccttcccacacctttgtcattaaccctttttatttcaatctctcttttagctggagacctgatttttctactcagttttaaatgctcttaagtatcatattttgtcactctatttgtagcacatctgtcctttcttctggatcttaaatacattctgaatgaaattcagtcttgttttgaaggtcagctttccttctattcaaaccatgtttgtcagttatggcttttggtttgtctttgagggggtcttgttttccctctcatctttatgaatccttacttgctgctctgcaacatgtgtaaatttcttgttcacagcatgtcagcaaataacttgtcaagcttcagtggctcactgtgatttttttctacctccaaagagtatatgagtagattcaataacatgctgtagagccccaaaccaaccctgtgggagaggtcagagttaccctcagattttgtagtagagactcaggaataagtagtgacacatagacagaaaacatcagaatgtgacaagcaatggctgaacccacttgtggattttgcactgccattttacctctttaggcaaaataagaggtttctgtttctgagcctagtctattcccttagaacctttccatgttatcctttatctttatgcaatgtttcccatatgtcagccattcatggccattcaccatcccattttttgttatgagctttcaaactcaaattataatttacgtgatatttaaaaaatttgtctctttaactttgtattcatttgatgttgccttttctaaccgtgaccataaataaaaacccactatcacatggcacaaacataaataagatcaaaagtagtatttttatcatttgtctactattggcctgcgcatttgctgaaactgcagcctattgtttctttcttgaaactggggagtaggaagccttctggttatcagttgctgcaaaacaagccacccaaaacttagtggtttaaaataatactttattactatcactcacatttttgtgggttgacttggctatcctgtggtactcgtttgggtttggcatgaggtttcatttgacagctggggcagggattatctgaaggcttgattgggctggatgttcatggtggttgtcttatttggctgggcaagggctgctacctgttagctgggaccgcctgaagctatttcctgtagtgcctacacgttgcttcttcatatggtttgtcatcacatgtggcagctaagttccaagagtgagtgctcaaagaagtcttcgtggacactgaggtttcttaggatctaggctctgaagtcccacaacatcttaaccactttctattgatttagtctagttcagattcaaggaaaatagtagggaagaatttgtggccatctttttatctatcacagttattgtcagaggggtgttaaagaatagcaaacttaaatgttctttgtgatgtaatcagagggattgaaagagaactgaaaggggaatggcattctaccatgtcatttaatgttatttaattctgtctccattcattgctttaactcatcttggcaccaccaatgtcagtgagcccctcctcaatgtattcaccctcttctgtgatgcttcatatctctttcctttgggatttcaagaagaatttggttgatatgttcttctatcattttgagggttaccttctgtcttttcctaatgctaaaaatacaaagaagaaaggtagaaaagcaaaagtagcattgtaatgaacaaaattagtgttttcaaggcaaacagccaagtattacataagccaactcacagggcatttttacaaaaattctggagaaatggctatgctggtttccagatttagaaacctctctggctcacttgaaaggactacttgggaggagggatcctatcactagacaccttccttcatgggtcaaacttttgattcaagtgtgcatgggtgagatactaagatgaaataatttgagtgtcaaaatctatgtttattatggaaaattttaaggttatattgtttctcaggaataacccaaacagacactgatgactagcattagtgacgttatggccagattatgtgaaaattgacaagcaaatatggtgtagttttcccctcttttaggaaaagcacaaagaaggatccattttgtgaaaaatgcacaaactcttaaggttaaatttagaaccaagggtcatttttaaatgaagtttgatggtatgatttttttgactggtatattgctttatatctgcatctagtcattatatgcatatatttcaaccaaaggtatacagttttagaaacttcctttcatcaagtttcaatttttccttttgcatttattgctcaatacatgattagtcatgagtaagcatccagaatgatatatgtattagctcttcactttggacaagaaatttcttccaatttatataatcactcaacatgacttaattgtcatggttaaatctccttgactctgtactcagtggcattaagcaagcaaatgttgcttatttttcactaagtactaactatgaagagctgttaggagcctctaggaagttaacttacatgaaaattctctcttgaccccattatatttttaaagaagtatagatactagccaatgctgggactatgtcttagataaatattcaagatgctctgagtggaatctgtgctaacattattaccactggtatagtttttgctctgaagatttatgaaatggattattattttgaaagtgttaagcactgttaggggactctcttttttttgacttggactggatcccacaattctaaaagtatttatgaaaacaatatgatgaaatgttaatgatggaagtgtatccttgaactttgattttaaaaaggtgttaaatcactgatgagtccttgtcttcacctttgcttagttccaagattaaactcagtcataaacatgatatttataaagagtttctcataacttagatattacaatagtaaatgaagcaacagaatcgattcacaattatgtatacaactcagtacaacaattcaaaaataaatatgcctagaaaaatacctggaaaaatataccaccatgtcaatagtcattgccttctgtttggattatattgtttcccctttggtaatctttttctttacacttttctttaattttttcaacttttctataatgaaaacattttagcattggcatgtgtcacttaactaaatgagattctgtgattgctaatgtatatgcttcagtgaattgttagtttttaaattatgttaatgaataaacagtttccaggccagtcattttctagcctcattaatgccatagtgacatttgttatactgtactgaacgattttatataagagacttgagcattcttgaatttggtatccttctggggtcctggaaccaatcccccatggatatggagggccgactgtaaacgccttctcctgatttgggttttatacatttgtatcagcagtcttataaacaccctagaaggaagctccaccttccagaagatgaggcagcatgctccttaactgttgaatgaagattctttcctgtttccactctttgtttggtgggcaggaaggctcctgctcttcagttggaagtggctgcagctgttattagcagataagcaggagtggcctggccatttctgtgactcacagtgacttagtgggattcatatcaagaattccttccttttctcttgacagttttcaggtacttcagaaggttaggtagaagggatatgagtgattaagatatattttataggaataattgaaagctgggcatttgatgtgttttgattttagaacagagtactggacagcttcacatttggattctgggcaggtatgaattctaatgagagagttaaaaatagtgctaggtaactagtaaagtaagtgacacagagactttcctttagttcttcgtccatctttgtttctcattcgttgacttgcattgcctcatcctttatctactctatcagtgtgaggttatagaataatagagagaaaaagaaaacaaaaataacatacttaatttcaatttatttattgaatcaaacattacctaaagttgttcttttgacattttttctcctgtgatacacagatgtctcactgagtatcaaatagtgagagggaaaaagattcccatggggtgaatctgcatggaagagtgtgcattaatctgtgcaaatgcctactaatcttggaacttctgaagtaaagaaaaatccattactactgctctatataaatattaacaacctaaaagtaacttaagtgatctgcaatggaatatgtgccatttagatcttttaactacttcacactttcataagacttaccacatatcccaacctcccactttaaatagacgtttttgaaaatatcagtcaaggagaatctttaattactacattgcttcagggaaacatacaattttggtaataagaaacactacttcaacagatctgttcttcacaaaatagagtacatgcaaatgatatgactgaactcaaattcagatgtttggcagttgagctatttggtgaaatgtcttgagggaaagatctttgggttcttttatacttgatgactttaaatctgtgaaaactaaggggctaaaataaaatgaaataactgggtcttttgtttttcttcttaatagtttattgtgtaaagaggcctcgttttcctactataccttattctttgatgcttttcatttccttgtatgttttggaaaaataatgtatgttcatagaactctaggcaccatacagcgacaattggtcaggccttctgagctgcaacacactgcagatgtgaggaagaattgtaatcagtaggtcatctgcctgcataattttcagggagccatcttgctcctaccaggacacatatggaggggcatgtttgcaattttattaataacatttttaactcacaaaagttcccacataaggaggccagcactgtcaaagttcttttttctatctgggaagggcttatttggtttattgtgccttctatgatcttgttttctataaagataggctgctaaaagtggtagacagttactctttactctatgccctattctacatcagtgctgaatgagcaggggctgtggacagaaggtcatgagggaggggtcagttggagggtggcagggcaggtaagtgaagggtttgggctaagtcacattatatgctcaccctcttaagtttcgtgtggtaaattccagctggaataaaaataagagccaccttgattgggaaaagaaactgggaggtgtctcggaagggaagatagagcctaagaagcagtatctattgctagcaagaaagcctgggctccctttgcccccataaaagtgtttagatctggtcggtgaaagtcagacttaaactttcctcacccacctcagagcagcattctggaatagttgctatcatttatagtgctctgaggatatttcaggttttgtttttttctttaaaggataaagtcattgatagaactataattacaaggaggctcagctgttgctgtaggtggtaacaacttataaggcagtctacaccggctgatcttcaattaaattattcatttctgcatgcaaattccacccattcttttcctttttatggcagaagctaccagtacctttatacaaatgatcttggtggggttcctgtcttcctgtttggagatggccttattgagtatgattcaagaaatagacagacctcttgccttcctcataccaacctacaaccatccaaccaaccaaccaaccaaccaaccaaccacccacccacccacccacccacccaaccatccaatcacccaaccaaccaatgatctaaccttttcataggacagaggcctttattcccagttttaaattcagtgggaagcataaaggactatgataaaattatttcttgaatgtcttattactacacaggtcagttgaacatgaaaggggaagtggagaggtttaaattgttaaggttaaaattgtcaaaattggagggctgtggtcattttacataatttacatatgtatattcaattttgtttaaggctagattgtaaaatatcctgcatagagcagaactggactattttaaaggaaattcttttgaatgggtaatgagcaagacatgatgtgaccaaaggacctgaaaaactgccaatttctcagttttaggcttctgtgatcttccccatactttctctgttgggtcattgctactcatattgattgcacggtcctctgatactcactcattccacagttaccatctgatgagatgtggctagtttcagtgctctgattctgttgaatgagattatgcagtgaacttgggtattttcttcagcttgtgatggtttaggaattgctgtctaggacctctttttatactgcactgaacacagttatttcccattttgaggtacttacacttttttgacaactattttttaaaaatttaatttaattttaagttctgggacacgtgcaggacgtggaggtttgttacataagtaaacatgtgccatggtggtatgctgtacctgtcacccaccacctagattttaagtcctgcatgcattgactatttctccagatgctctccgtccccctaccccccaaacccagcaggccccagtgtgtgctgttcccctccctgtgtccatgtgttttcattgttcagcttccgcttataagtgagaacatgcagtgtctggttttctgttcctgctaactcactattttgcatgtgtatagaaaggcgtttttaacttacttcaactcaagatcaatttcttagtcacctactatgcacaagacactattccaggtattgcaggaattaaaaggtaagtgagacatgggctgtggcagtaaattggtattaaagcaggattgggagatggcattcagaatggtgaagaaataggagagcatgttaggtacttcactgtgagtgttaaaaggaaaaagagatcacctgaaactgggaggcatcctgatttgcttaggtctgctggttttgttttggtgaggtttagggccaatcaacaaaaacaataagttagaatttcataaaggaaatagtttaaagtatctactcctagaaacaaagtatgtgtgagaggagcagttattggctgtctgctttttaaaatgcttgcccttgacttaaaggtatgaaaagagaattttaaaaaatttcagtgagtgtggtgggcactatatcctagttgattcttaattattcaggagctaaatatcaagttggagaattatctaagttgttctctttttctctttcttttattcctgactcccatctgatgtttgtgttgtttcttttttttttcttttcttttttttttttttttgagacggagtctctctctgttgcccaggctggagcgcagtggtgcgatctcggctcactgcaaactccacctcccgggttcacgccattttcctgcctcagcctctcaagtagctgggactacaggcgcctgccacgacgcccagctaattttttgtatttttagtagaaacggggtttcgccgtgttagctagtatgtgttgtttctatatactaattgcctcagagctggtagaaaggaaataacaagattaatagattaattgcaaatctttagctatattagttaaggaaaaggctgtgatatttgggcaaaatgagggtaattggtgaattgactatttgttctggttcattatcatcgtggataattgagagctaatggaagtcattggaactgggcctgcagggtgatttaagatcagaatgtttcttaagggtgggaagaaggttcttgatgtgatacagtacagagctctttcttattctatattaaatgctcataatggtagactggataattgtctatataataattgtctatatatatataatggcctctataataattttgtaaagtcttactttcttcctttctatatattttttgggtacagtatttaagttactgagcttaaaataaacttcctgaaagagtaatctgggttaaaaatggttatagctgcagaaatacatactgtgaattgctcccggaaatctgtacggcaaatgtaagagcattttggctcaacacacttaactctaatgcatctcatccaattagagtttatggcaactgtcattcaatattagcagctatacttaaaatatgagtgttttaaaatgattgtgtttatggtttctttcttatctcagtaaaaacagtttggtttgccagcaagtttttttgtttgttttttgttaggtaccttctaggttgtaaatggacaggaagctgtctatcaagagatttctttcttcagctcttttaaaagtagtgtgagctggggatgatatataatatgataaaatacctaatggatccctgaatccactttcattgagttcatggaagtttgtaaatgtgcagctgtagtggcagagtgtttatcagtgctgagaatatcactgttcttgcttttgactttgtgaagtcggcatattcacatccacaacgcctttcttgtaaccatagcaaccaagacagaaggtttctttttttctctctcatattcaaaagcactattaagatgatagattttatttgaatgaggtatttgcagataagagaggcataaacttaaattctgacctctggataagtttttttttcttcgttaggaaagaaaaatattttatagttgacaaaaacattttataggtgacaaaaattgtatatatttatggtataccaagtaatgttttcatatatgtatatgttgtgaaatgattaaatcaagcaaattaacatatcagtcacctcacatacgtatcattctttgtgagaacatttaatatcacttttacttctgtacagcaaaagaaactatcaacagagtaaacagacaacctatagaataggagaaaatatctgcaaattctgcatctgacaagggtttaatattcagaatctaaatgaacttaaattaacaagcaagaaacaaacaactccattagaaagtgggcaaaggacatgaacagacactttttcaaaagacgacatacactcggccaactagcatatgaaaaaatgctcaacatcactcgtcatttgagaaatgcaaatcaaaaccacaacgagataccatcttacaccagacagaatggctgttatgaaaaagtaaagaaataacaggtcctggtgagtttgcagagaaaagagaacacttatacactgctggggtgggaatgtaaattagttcagccactgtgaaaagcagtgtggcaatttctcaaagaatttaaaacagaattaccattctgtatacacccaaaggaatataattaattctgccctaaagactcatgtatgcttatgacaacaatattcacaatagcaaagacatggaatcaacctaaatgcccatcagtggtagactggataaagaaaatgtggtgcatagacaccataggatgctattaatatgtaaccataaaaagaacaagatcttgttctttgcagcaacatagatggagccagaggccataatcctaagtgaactaatgcaggaacataaaaccaaatactgcatattctcacttataagtgggaactgaacattgagaacacatggacacaaaggggaacaacagacacgggaacctatttgagggtagagggtgggagaagggagaggatcgaaaaactacctatcgggtaccatgcttattaccggggtgacaaaataatctgtacacccaacccctgtgacacacaatttacctatacaacaaacctgcatgtgtaccccttgaacgtaaaagttaaaagagaatctctcttagtgaatttcagctataccatatgttattacagaccatagtcaccatgctatacaatagatctcccaaacttatttattctatctgacactttgcaccccttgaccaacatctcccacctatgccagttcccagtgtctggcagctgtcattctactatctacttctaaagttcagcttttttagattccacatataagtgagatcatgcagtatttgttcttctgttcctagcttatttcacttagcataattcctccaggttcattcatgttgtcacaaatgacaggatcccttttttccagctgagtagtattctattgtgtgtatgtatacatatattaaacaccccccccctcacattttctttatccattcatgcattgatggacacttaggttgataccgcatcttagctatcatgaatagtgctgcagtgcatggagtgcagatatctcttcagcatattgatttcatttcctttagatgtacaccaacaagtggtattgctggattatatgataattctatttttaattttttgataaacctccattgttttccatagtggctatattaatttatatttccaccaacaatgtacaagcctttccttttttccgcatatctttccagcacttatctgttgacaataactattctaatgggcatgaggtaatatcttattttggtttaatttgcattttcttgatgattagtgatgttgaacatgttttcatatacccgttggccatttgtatgtcttttgagaaatgtctgttcaagtcttttccctgttttaaaattgagttatttgttttcttgctattgagttgcctaagtttcttatatattttgaatattaacttcttatcagatgtacagtctgcagatattttctaccattctgtgagttgtctcttcactctgttgattgtttcctttgctgtgccagaactttttagttttatgtaattccgtttgtctatttttgcttttgttgcttgtgcttttaaggtgcttaaggttttttgcttgtgcttttaaagtcatatacaaaaaaatcattgcctagaccaatgtcacgtagctttccccctgtgttttctgctagtagttttatagtttcaggtcctatatttaagtcttcaatctgctttgagttgctttttgaatttggtgtgagataaaggtccattttctttcttctgcatatggatacccagttttcccagaactatttattgaagagactgtcctttcttcattgtgtgttcttagcacacttgccaaagatcaattgaccataaatgcataaatttatttctgggatgtctattctgttctgttgatttatgtatgctactttatgccagtagcacactgtctcaactactgttgcttttaggatgttttgaaatcaagaagtgggcttccagctttgttctttttcaagattgtttttgctatttggggtcctgtaatatcctttatgaattttagaactgctttttctgtgtctgtgagaaatgtcattgaaattttggtggggattgcattgaatctgtacaccatttgcataggatggacattttaacaatgttattttttccaatctatgcgcatggataatctttccatttatttatgtcttcttcaatttctctcattaatcttttgtagttttcattgtacagatctttcacctccttgggtaaaattattcctaagtattttgtttctttgaagctattgtaaatgggctggataaattttgttaagcctctttgtctcatctccctcaccagctacttctgttgatttgggtcaccaagcacactataatgttttctgccatatcatccttgaaatgttgcagagattgtttggacaaagacattttaaaaataaaccttagacatagaattttgaaaacaaacataaactatacacagctacaatgaaagattaaatataaatcagtcaggtgctttacaaaaggattaaaagaacttacggtccattagtgccaaagagaaggctataaaataaaaccaagagaaggatcaaggattttttttccatgtacaggaatgaatgaaggacttggggtcccataatgtttcctaaatatttaaggtggtattagtgtggctgtgctcactttgtgcattgtacttgggacctgttgggcaacaacccaagtctggagatgaatagagaagttactcccacgtcactggcacagaccttcaactctgacatgatcacatctatgtctcacagatatcttacattttacaagtttaaatttcttaatcttcccctagaattatagttcttttccagtcttcatgagtcaataattcttctatcttcttaggaccttgggagccatctttgacatgttcttttacattcagtgcatcatcagtttatgttcattgtacttccaaagtgtatgtttaccaacttccacatccacctccattgtcatactgtagtattccaagccactgactcttgcatttgaacttctatagtaacctcctcattgctcttgtatcttccataagagtttcttccaaaattccagaatagtttcctcaaacttgtctccacagaagcgaatatgtagaatatggtacaagctttgctgctgtgatgtagtattctctaaatagagtgtttcagacaagatagacatttaattatccctcaaataatatccaagctaggcaaggggtctttagcttttttgggttgtcctaccatcctcaaaacacggtttttatcttgggcccaaatctccacttgttgccatctcctaccagcagttggtggggaaagggccaggggaacacatacctagtcctttcaaggggaatacctggaagcttggagagtttatataacttcctgaaggtcacacagctgtttagtggcagggctgattggatctgaggtttgtgtgattcagaagccactagatctcttttatggggaaagaaagataatgcatagctgttgcattccaagttgacactgaagctattaaaacccatattttgaaataattgtgcaaagtttcattaatctcaagtggagacaagaaaatggcaatattaagagtggaaagataaatagaaataagaacatttgagtttgtgaacacaaatggttggaatgatcctgtttgtaagttgtgaattatagggaacagatattaaatatttcataagaaaataacataccttccattaatgggggtggtggtgagaaggaggatcaatggcactatctccagtgggagttcttaactgggatgaagcaatgttctcaataaaatacttaattttctatttattttcttgattacatccatttaatagttttagtagagagatgtcggtaagtataagcaactgctgctttcctaacatcaagtagaggacaggtgaaatcagattttaggatacctacagcagtgtctcttaaccctgaatgcacattagaatgacctgggagcatttaaaaagcccagatccagggttgcctccgcaattacaaaatcagaattctgggaatgggacctgtatttgttttccatggctgccataacaaagtaccacagtctgggtgacttaaacgacagaagttgatttttttcatagttttggagggtagaagtccaggatttaggtgttggcaggtttggtttcttctgaggcttctcttctctgccatcttctcctcctggtttcttcatgtggtcttccctctgtacccatccgtatcctgttctccttcctttataagaacaacagtcttattagagtagggccaccctaatgacctctttttacctttttacataacccatctccaaatacagtcacatgttgaggtactggggattgggacttcaacagactttttttttttttttttttttggcagaggaggggacacacaattcaacttataacaggattaaagcatcagtgtttttaatcggccactgtcttcccccaagtgattctaatatgcagccaaatttgagagtcaatgccctaggtgggattctcaaacctggctgcgttagaatcacctgggtaacttaaacaacccccaaaaacagcacataccaatacttaggcatcagcctcagagatgtgatttgatccgtgtggggtgggatgttgttagtttacagagtctcccaggtgattttaatgtgtaaccaggtttgagtatcactgcactaatatgtgtttcttaactgtataaatggaagcatatttcttacctttctccaaattgttttttttgaaaatttttaataaatgcaagttattttaatgaaagatatatatttaatgatgtagtattcaggtctaaaaaatgaacaaaatacttttaaggtgttatgtttcaaatcaaatgtgggttttgtgatataattttctttgtgacttatagtccttttttgcttaatgaaaataaatcaaaagaacttgggcctatcactcagaaagcaaatgaagtgaagaaactgacactttaatgattaagttgactaaagtgtcacagcttttagtgaggtaatttcttgattaaagaaatgatgtttttcagctttcagaaggaggctagactttcctttccagatgatatcaaaatctgataacaattccttgatttattcaggccaatttctgtgttttgaagtaaagccacttatctggcatttttcattaaggcttgacaacagctggctgcttcccagaatgcagtgctgtgacagagattatgttataaagccatggatcagctgcctttgtaatttgcttaaattgattatgtgtacatttcttcactctctggacttaaaagaagcctgcatttgggtgaggaaacagtattattatttcaatgacaaaagaccatgtctattacgccatattacacatagacacactgccttttccattgtgctctaatagtatttttagtttcaatctttttggaaagttattttaaatactatgatttctatttcggctgaattttgtagctttaatcaaataattaaagaagcaatatttaagatcagaaaagcattatttaaatgatgaaagtatacagtcttaggaaagtagttgatttttatttgtcctttctgtatgttaatatctgatacagatacttgctgatatgctttttaagttaaaaaaaaactaataagtaatcattatctaaagttgcagggagcccatatcttgctgaaagttctacaagaattccaagcactgagattaaactagacatctataccaataagtttagataccttgtttaaaaacaaatgttgccctagaagtacactagcaaagtacccaaagagaggaaccaaattatgggttttccttttattgaactaagtagtgacctgggaagcaagtgcccccatgcactgaggtaatgattttatcaatgaaggggaatactattttttttttttttgagacagggtctcgctgtgttgcccagcctggagtgcagtagtgcaatcacagctctctgcagctttgacctcccaggcttgagcaattttcccaccttagcctcccaagtagctggggctgcagatgtgtgatatcatgcccagataatttttcatttttttatagagatagggtcttactatgtttcccaggctggtctcgaactctgggctcaagcaatcctcctatcttccaaagtgttagattactggcgtgggccactgcacctggctgggagctacttttggttgaaaattgattaaataaaaaagaatgagaaatgaggttttgtgttttagttttaatcattttcaccttggaacaagaaggtgcgatttggccagcaactcaaagctgctgtaattcccactaattatgtgggttagccctcaccattctgctttctctctctctctctcccattgttggagcattaacatcttagccccactggtgcctttaatactgtttggaattattttattcatatcttggggatccctatacagtggcatctaagcttagctacccacagagatcccctggggaacctgttagtcatgacctcccaggttcatcctcgacctactgaatcagagtttctggggatggaactggggagtctctctgtttcagttggtgattcttggtgcagtcagccttccttcactcttttctctcattgatttgtcccatttcattgatttgtgccatttgctagaagaatcactttgtttttaactgtttgttctggtatttacctcctcatgtgaagaatatttccttttgttacattagaaacattctctagatagtcattgtctttctttgaatttcacaggaaagggctccctggtcacaaagcaaacccctccacttttgcttttcaatcagtccatttccatctttagttttccttttcaccaccatttaacttttttaaaaaattgcatcttgcccctttgccttttaacaaacgtagatctccccatctagaaaattcattcctccgtattgccactaccactgaatttctcattctttccccaccaaacttccagaaagaatgatttatttcttccattccactaaaatttatggttcttgttcttaccactctaagcctgctcccattgctaatttccccctgtaattatgaaatcaatttctccctatagcagttatattggcatttcaaagcaggaaataaaaagtatgacgagaactatgaaaggaaaaggtttttattgatcttttttagaaatgaaatttgaaatacacaagggacgcatgaattttatctttcatgaacatttgatgagtaagtgtgggtgccccagtaaagattctggcttcctgcaaaggataaggtcagaagtactgtcctgatttatccttgatgtgttcatcacaggttctcttgtctaatggcccataactaagtgaggctttgattatggtatctaatgatgaataatcaaagtttattgcaagatgttttaaccagacttctcctgatttggaaattttttcctgttattacaatgcagtaatccccttataatagaatatcaagccaggtgtagtggctaacacctgcaatcccattactttgggaggcccagctgggaggattgcttgagcctgggagtttgagaacagcctgggcagtatagtgagaccttgtctgtacaaaaaaacaaaaaattagccaagtgcagtggcatgcgtgggattgtcgggggtgggggagcctggaatcacttgcgcccaggaggtggaggttgcagtgagccagattgtgccactgcgctctagtctgagtgacagagtgagaccctctctcaaaaaaaaaaaaaaaaaaaaaatcagaattcccacattctctgcagttgtctgtaatttataaactatttttatttttcattatttcttgattatttaaattttaaaaattatggtgaaagtattacatgaaaataattattaaatacttctataagacacacacacacacacatacatatttcttcactctcttctcccattgatttgtcccatttcattgatttgtgccatttgctagaagaatcacttcgtttttaactgtttgttctggtatttacctcctcatgtgaaaataatattcctcttgttaaatcaatttactttctataggatatgttaggatttttactcatttaaaccttatacttcctatacctttcctcacttcttccatatataattgattatgtctaaatttttggttacatctttttttttttttttttttgttactttgttgtgactacataagtgctttccagtgttgagtgatctgcactggaatgtgtggctgccttttgtatttacttttgttgtcagttttacctagagttagtaattgcctcattttttcctttgtttaattttctttgaatgtctaagtcttctaatatccccaaacagttctgtaaaatatctctcattacagtgttctgtgtggtcaaacagtcagataatttaccagctcctttttcattcctcctccttggagccctttgcttcctgccccagcatgcactgtgctctctgggcataaggcacagctgtcactctgggaatgtccattgcctctcttctctgtttcctaaatccattttctcttcttggtttattcctttgttttggaggagtatatcctttagtgacttcttgagaaaggttacttgtaaaatgaattctttagagtttgcgtatctgggtagatagcttgcatagactagttcagtgcaggaggatcaaacaagttagccggatttttcactgaggccctctcaacatatcattctgcataagtcttttttcttttttctgaagagacaattttgtctcttcagagaagaattctcagtttcctgtcaggggaatgcaacctgaatgctgattccggggttgaaggaacttagtgatcaatatacagattttcacacagtgtctctattttcagcagtggatcttttgcttgccctcctttttgactgctgtgcctgagtctcaagctcctatggctcacattctctggagaataaaccccagatttctagtgggtggtagaggttacaacttgggagcagtggtgtgctggtaaatgtttaacaactagctctctgaaacaaaacaaagcaaaactctgatttgtagcatgtgcagtttgtgttgtgtaaatactttcactagcattgatttcaagctaagaatgtgaggtcactgcaaagttggaaagaaacgttaacaataactcttgcaagccggtataagccagctgcagctcaccaatgatggaaagtctaaatacccattcattttagcaacttcccttacctttagcttctaaagtatccagtatctcaatttcttaaacatttccagggacaaatcagcttgcttcttgtagtcactggcttgacttttcttctctctgctgtttcctccaactactttcatcttcagatgttagactgcagtcacttctttatttcattgaaactggagtttgtgtttttgtttcctatcatctttgtggttatggaattttgaaagaagtaacaagagcaaaagtatctttcttttgccatcatgaaactgaaagttttactcatttttctaaataaaaactatagagttgtacaatgacattccttattgttcagagtgttttaatatcttatctaaatgtttaaaatctaatttatagcataagatcctgggaagtactttttgaccttgctatatagaccaaattagtcacggcagctttgtaatatacacatttcagatcagaggatgcttgggaattacagcagttcatggcaggattttgaacttaaaagatgcggggagaatgtgggttggtctagagagatatcagtttttgagttacctgtgttggaccctcataggttctttattagatattctagccaaatgcattgagctctaagatacgtatgctttttaggggaggtaggtgagggtggggatgagggcatgcttattcagttttcagattagaaacacagaattagaaatgcagaatgtcccagtaaaatgtatacaccccttagatgttaatagcacaaacaaccaattgctttttctatttcacggtcaacagtgttcttaaagacaggataacatagtggtgaaggcatgggatgctcttgagtgccgtggtcccagattgctgctctgtcaattgctgattgtgggaacttgagcaagtttcttcaactcgtggtgcctcagtagtctcatctttaaaattaagatagaaatagaaattcctcatcagtttgttttgaggattaaatgagttaatatgtttaaagctcttatactttgtgaagcataataagtgctagataaacagtagttattattattgtttctgttgttatagaacaagtgatgaccaaattggcattggttaacacctgtccagttattaaaatttatattaatacactttaatattacattaaagtaatatatgtatatgtacacacatttttattagaatatgttgttgagtgtgattcataactattttgtacctttgtcactcctctgataatttaacaaatataaatttaatgtcaaccatgtacaatttgactatgctaaatgctgaggttactgagttttaaaatgaaactagaacatttcttcaacgttaacactaaaaaagacctccagatagataagatttaaacctttaacaaaaaaaggagagccatagaagtattggtgggatatacgattgaatggttttatatatttggagtagaagaggcttttctatttatttatatgaaaaatcagaaaccctaaagtagaagattgacatatttgactaaataaaatttcaacttttgcctgaggggagtctccaaaacaaagtcgagaggggaacagaaactgggaaaaataatgacagtacatacgatagacaagagtaagtttaattaccaatcagttggaaaatggcaaacagtctaaaagaaaactacaagaacaggctgtttacagaaaaagaagtgaaaaatggcaagcaaagataagcaaaagtcctcattatattttaaagaaattaaaaacaattttttttatttattggaaatgagggtgctagtggaagttagaaagatatatgaacagataactaacatttccagagttctggaatcaagggagaatatactctgggggcaggattgtcttgacctttgccctgagtacctggcctcctctctactttcaagatactctgttgagtagaacgctcctgcaggctcctttccttggaaaaatgccttggcagattacctgtgatttaatgaggccttccagctgtgcattagtcacagctagcaattacttcacattcatatgagccaagcatgttcaacatttaaaaagcctctcttctgaaagagcctgaattggctggtgtgtggccgtttggttgggttttgagattgctttctgagaccttctactgcagatccctgtgtacatcttcctcaggggcccccactctagaggagaacaaaataaagcaaatccttagggcttctggaggagaagggactagatgggtttgcttatgggttcatttacccagtaaatatttattgagtgcttactgtgtatcagatagtattctgatcattgggcaaataggggtgaacatacgttttcatggagcttatcttttaggggagtgaggacagataatttaaaaaattaagaatttcagatgactgctatgaaaaagatgaaatcaggtaataaagagtaaagggtagaggtgcttagataaatatatatatatatatatatatgtatatacacattatgtatgagcaaaatagtgcttctcaaactttagtgtacatcagagttactagcaggacttattaaaacacagattgtttggccctgtccccagagtttctaattcagtaggggcctggtgtggggcgtgggaaacaaattttcaggtgccgctgctgctgctctggagacactttgagaaccactggagctgggcagagggtgatcctggaaagcctctgcaaagaggtgatatttggttagagaccttaatgacgagaagcaaccattcatgtgaagatgagcagtggtggggaatgtaggctgggaatgtgcaaagtagagaagctgtttgtggtttgaagaaagcaaaaaggctctgaggctgcaatgtaatgaatggagacagtggcagcagataaaagcagagaggaagatagtctgaagatctgccatgcagagtgattatcctctgctctgagtgcacacttaacaaaaacctccaaccatactggagcccaccccaagagagagactcagatttcattaatctgggtggcacttaagtatttttcaaaactcctgagatgattctactaagcagcaaaggctgagaatgatggataggggtcctttgcagccatgggaagttaagattttatttcaagtgtcatgaaaaccattggggagttttaagcagtagaggacataattagggggtagtttctggctgctggttgtagaatggattttgtaagagattaagaatgagtgaggagaacagtcagaaaatgtcataattgtccaggttaaaagtgatgttggcttattttatgtgatagtgatggggatgatgagaaatgagaaacaggatggtagatgggattttgggggtagaacagaaaggatttgctgatggatgggaggatatgagcagtgagagagtgagtgaattcaaagatggctccaaggtaaccttttaactggtgaaaggtgacactgttaactaagaacgctggagtagaaacaggtttatggagaaatgacaaaattttgttttggatttattaactccaagatgcctttttggaacagttaagaaccaggttgtttttagagaaagggagtgggactgagggtagacagttgccttactcctttgacaggcttgtgatagctagctgggataggattattttttatgtggactttatatgcattttgaaatatgtaaactttcctgtaatgtgtggcttaattttttttttttgttttcactcactaccacccatggcaaatatttggctttctaaaggggtaaatagaatcagagtaggaactttctagaggtttaaacctgtgagcatagtggaacatggtaggcactcagtgtatagttgttgaatgaatgaatgcatgaactcacttttatatatcaatcccatttagcattttgatgaaagatgtgggttcagatcatattgtatagggaacatcaaatatccagtggttaaagattatgtctcaattattaccataaagtaactgtagaatgaatccactgaatcaaaaggggcagagggttttggtataaacggtgttgtgttccttgggttatccttggtaaaggggcagtaaataggatctaagacccctgtgggtttctagtcccatgtctctgatcatatgtttgccctttgtcatgagccagtataatctgtgtgatttcagcaaaatcagcccaagtttgggatctgccttcacagaaagtcctcctgcttctctgcatgccagagcctgccagggggaatgttcagagatcagaggcaagaactcccataagccagcttggtgctgtgtatgataatctagttgggatcatacctgattatctgagatttcacagatgatgaacatctgtctatgagtgccttttctgataaaccagaagtcagaatttgtttttggagaatttgttaaggagaatcaattctacaactagggagatcagagaggctgctgagaactgttcccagactatattcagatgcccagatttgtgaatgagcaggtggaatctctccctagtccaggatgctgtatctgaaggttatgaaatggacatctgcactcatttgtccttatcaaccccatccagggacaagtgattccacttcaatcttgtgtaatggggtaaaaagttaaactcatgatcttaacagctgtcactcaagttcttctcaaggaggaaaaaaccctatttgtgaaaataccttgataattcacttagggatacaaaaggaaaccagagaacaaatcagaagctagactcagggtagcagaggagaatggctaggttgatacccttacataacaaggggaattcattgttctctttctaaggaggtaaacagagggaaaggggaggagagagaaacttcagggtgaagggacctgaggaaataacatagtggtaggatggctgaaaactaatttaagaagggagatgttcaatgttcagttggaaattgtttactttgctgaaatgtaaactcccttatgcttccctttaaataatttataaagtctcttatattaatggatgcattgtgtgcgtgggatttatgagtggggaactcaagaaagtctgagcttcatatccagtgtaatggtggagaatagagagggctattggaagtgggagttgagatgactttgagaatgcaagttctgcctccacctccaccattgcatgtacctagggaatcctcagaaacttggggcagagctttggcagaagactccaaatccaggtcacatttgcattataacattttggatagcaaagacaatttctcttgacaaaatttagggttctctctctgttaaagtgatttggctcatcttcagctttgctggatgtttcattaaacccgtgcttctgactcaggggcctctccactggctgcttccaactagtagagtgtcctttgtttgacttttctctgttttggatcttgttctccttctcttgcccctctcagctttgtgggagaccagttcttcagttccacagctgggggtctctcgtaccccgtccagcacctgaattcagccagacctctaataaccagggaagggagatcagacatgactaatattcagggaaattgttttcctgagcataagcatgggtggggcatttgtttttcaaagaccatatattgcatgatcagatagatttaaaccagaaaggaatatggtatatcaggtaactttaaaaggtcaccgaagagaggaagaagcaatagaagattcactagtagccgtattgtaactcctagaaccagtgccttgaaagtactctacatgacgaaaacgtcacagtcagcacacatgtttttggaggaaatatttacaattgctaatataatagaattaaaaaatatattttaatatttttactgagtctattttgctacttcagattttactaaatctaagtaggcagaattgtaagataggaatgtggtttatatgtggatattaaccttttgacttcactagagcagttgcctaatattctcctataatgaagttgtttccagtaataaaattgcattgcaaaaactgcttaggttatctgaggccagaattagacacctagaatagcaggaaaataattctcgcctgagggctgctttagacaggagaagcatggttgtgaaatattgtattgtgttcccttctgtagaagttgctacttaggaggctgtttgtgttctagctaagagtctggagatgggaatgatggaactagtgggctaagaaggtcagggatacaataggttacatgactggaatggctatagaacttatggtccatgattaagtttggtggaggtataattacaaaatgaacaaacatacatgttttcatgccatacttatctctgaaataaaattgcatgtaagtacctataatggtctgctattgtctgtgcagcccttcctccagcctttcttctggcaacagcactctcttccctttgggaatgactcgagtgtccagtggatactgccttgtgcttcacatgaccctgctctttccctgcttccatttgctgtcttaccagggccacagtggactgtgcaggttgggtacctgaattaagctggctcttcccctgaaattttcaagcgtattagaaaagagtcagttcctttggctgtggaatttataagaggtgaaacccaggagcttctgacagccaggtttgctgccagaggaggaagccggtctgcagtgagaaggtcagactgtggagagaagcatacctcctgtagtttgagtgttcaatcccttaataacacaggctattttagcattcttctaatatattttaattttgctttaaagtaatctaatctggatttctgtcactttacaacaacagaaattccagcgaacacataggcactgtccataggaaggacgttttattaaagactagaagactgttgtcatcaaaataattctgaggtttaaaacactctgaactggttgcttgtgggacgtgactgaggaacatgaacttgtgttggtagaaatcccattgattgattgagtgatttattgtcttctgataaatatttaattgttcacaaggccagtccagaaacctggagactaatctgtctcttttgattagcaggacagttgtcgaaactcattctgtctttgtaataagcattcgtgattaatttaccaggactgataggatcctgtcactgtgacccctaactgagcaaacaagtcctttctcaaacctgaatgagaacagcctgggtgtttacactcaagactatttattggcaacataatttagcagtgaaagttttctttacaatccttctatcccgtgatagcctcttttcttctctgtgggattccctggtgttcaagaaagtgctctttcaggaagtcaagggacattctctagacttttaactttatttatgtcctatcttaaaccttcccagccctaagttagtaccctgctagtgattagttcaagaatgtgataacctgctctgtgctgaagtgaaattcatcaataatggcctattttgttggtcttttcagttagcacttggcttttaattcaccagatgagttagttgtggattgaaggtgcatagcaagaaggaaaatttttttgtggaagcagcacccaggtgccagcagtaaacgtcattaaatttattgatgctgaaattcttttattggagagcctgtccataaccattcttggtaagcagtattttatctcaagtctattttcttgtggggatcctacatcattgcacttgtgtggatgaatcatgcctaatatggttggcaaatctcttcttgagttgtagttcccataattctcacatgttgtgggagggacccagtgagagataactgaattatgttggcggtttcccccatactgttcttgtggtagtgaataagtctcatgagatctgatggttttgtaaggggtttcccctttcacttggctctcattctctcttgcctgctgccatgtaaggtatgcctttcaccttccgccatgattgtgaggcctccccagccatgtggaactgtgagttcattaaacctattttcctttataagttacccagtcttgggtatgtttttatcagcagcatgaaaacggactaataccatgccttcatgcactgtaagaataggcactatttgtagagagctgccctgtgccagatatagctggtgcctccacactgtatctcattgaattcaattttgagaacaatgttatgaagtaggtattgttatccttagagataacatacagagaagttaatcaggttggctgaggtcatatgactaatgcggagatgtaactcgggtttgctgactctgaagcttcttttgtctatataatttccaaagtttggttttccgtaccattctaataaacccagaagacacttaccagtgctgcttccttcaaactggactccttgcctatatgagttaccttcttacctgcctttagttgtggtgtgggcagtgggtgctgtgttaatcccaagggaacagaaaacctctggaagccccccatggatcatgacttaacctagctgtggaagagtcttgatatcaaccaagaatcactaaatgatgatgcacaggctgagtgcaagttgcttgtctgccattttgctcagaggttaattcctcagggtaattgggaattattgcatgttaccttagggtggttgagttattgattgagaacctgtgattctgattcctagaggcatattggagttcaggtctgaaggttctaaatggaccacaatcatgctcttacttatatattaatatatcagtaatgaacatctcatcatttactcaattttagaagcatctggattgaaaaatatattgatattctcctaccaaactgaattatatctcagacatctaaggatcaacattttttctatgtgtttttgttatcttttctaagtgttttaaacagttcttcgtgtattccagagttttttttttttctaaaatattgctctatttttgctagcttcctgagtagtcaccaatgccacagtagaataaatctgcatgtatttttactggtctacaccttggcaacaatacacatctccatgatgggacagaactgaaataattttgccctgtgtgtacatggctgtttgtttttaaaaaattttctgactcaactgtgactgactacataatactgggactgacatcctatcatttggatacatggatatttagaactgaaagctcatgagagacaatatggagggcaataaactggcatgaaatgccttatgtttttccataccagctaaaggctcttgatcctctttttctcttggccttagaatgaggtgactgagtgaagtgaaacgaaatgcaagtttcatttcaacttaaaagctggaattctcaaatgccaaataattggagatttgctttctgaggtttgatcacaaaacattttgtaaatagcagaaaactgaccacactttatgttgttcactgtgttggaatagaatttaaagacaggaaggcctgcagagagcttcaggttagtttctcagatgtcttgcctcctgtttccttcaaaatgatcaggagagattttaatctctatggtttttcagcatctgtggtttctttcatgagcaagcatcatagtgggtgtcaagaattatatgctaatttagtataatacgatggcatcatgtaatgcgtgtgcacttgagaataatagttttggaggcgcttctttgctgaagtatgattatattcagaaacgactagctttgtaagtgatagtagctactgacttctatgaatttcacacttaagttcattaatgacagggactgtttttggtattctgggatatgcactatttctaaccatctttgttctttctctacatggcagttaggaaagaacctctgacagaatctaggaactaacaatcagtgataattttgatttattttaatttggaggctaaagtgtattacaggaaattgtctcttcaagaggaaacatttaaaaagtattttaagaatttaagaggaagctatgtggagaattatcatcctggaattagaaacagtttctaattccagagggcatgatatgtattcattttctaggcggtgtatataccagttactatcagaatatgctacattttaggaacaggtatcatttccatcagtcttttccttcccattcctatacgctttaccttagtttaagcatctgttaccaccactcttctagatagttgtaggagtctcctagcttttctcctggctctcagtcttttcttaatacagctttgcagacactcatcagatagatcaaacccagatgggatcaggtaaaagcctttggtggcttcctagtgcctaccaaataaaacccaaacactgcagctttgcagtgatggtccttgacagtctggtgtgagtccagccttgttcctataactctagccagaactctgtgtcctggttgattcaactactttatttttattttttatctaatttttttctttatttcttctaaaaaaaaaaaaagaaatgggatacatgtgcagaacatgcaggtttgttacataagtatatgtgtaccatggtggtttgctgctcctattgatctttcctccccttactcccccatcccccatcaggccctggtgtgtgttgttcccctctctgtgtccaagtgttctcattatttaactcccacttatgagtgagaacatgcagtgtttggttttctgttcctgtgttagtttgctgaggatgatggcttccagcttcatccatgtgccggcaaaggacatgatctcatgccattttatggctgcatagtattccacggtatatatgtaccacattttcttttttttcctttccttttttaaactttttattattattttttaattttaccctaagttctgggatacatgtgcagaatgtgcaggtttgttacataggtatacatgtgccatggtggtttgctgcacctatcaacccgtcatctaggttttaagcctcacatgcattaggtatttgtcataatgctctccctccccttgccccccatcctctgacaggccccggtgtgtgatgttcccctccctgtgtccatttgttctcattgttcagctcccacttatgaatgagaacatgtggtgtttggttttctgttcctgtgttagtttgctgagaatgatagcttacagcttcatccatgtccctgcaaaggacatgaactcattcttttttatggctgcatagtattccatggtgtatatgtgccacatgttctttatccagtttatcattgatgaatatttgggttggttacaagtctatgctttgtaaatagtgcttcagtaaacatatgtaccacattttccacattttctttatccagtcagtcattgatgggcatttgggttggttccatgtctttgctgttgtaaatagtgctgcagtgaacatacatgtgcatgtgtctttatagtacaatgatttatgatcttttgggtatatacccagtaatgggattacggggtcaaatggtatttctagttctagatccttgaggaatcgccacattttcttccacaatggttgaactaatttacattcctaccaacagcgtaaaagcatttctatttctccacagccttgccagcatctgctgtttcctgactttttaataatcgccattctgactggcatgaggtggtatatcattgtggttttgctttgaatttctctgatgatcagtgatgtcgagctttttttcatatgtttgttggccatataaatgtcttcttttgagaagtgtctgttcatatcctttgaccactttttgatgaggtcgtttgtttttttcttgtaaatttgtttagttccttgtaaattctggatattagacctttgtcagatgggtagattgcaaaaattttctcccattctgtaggttgcctgttcactctgatgataattttctttgctatgcagaagctctttagttcaattatatcccatttatcaattttggcttctgttgcacttgcttttggtgtttttgtcatgaagtctttacccatgtcaactactttctttacttggttattctctgtttttcccttcataggcatttgcttgtgccacctcttttgatattgttctccttctatcttataatcaagtcaagcccaactattcaggcctttttaaaagcttttaattccatacatttttttccaactcacttccactaggaattatcttttctttctttaactctgctagagtactgaaactcacttaaagcactgtgattgttcctttgtgttataattatttcttgtgtgtaagttctttatgttgtatccttctactagattatgactttttgaggcagaggccatgtcttttgttttgttttcctttggatagtaccttgcagagggttgacctttataattgctagttgaatgggccagtggatgaagggttttagttctggtgaaatctctttttttgtagcttctttattcttgcttctttctttgttttagaagcctctcactagtataaagttggtggattttgcatgatattggatacatgtagatatgttagtctgaccttaggctgttaagttgtgaccattggcattctagtcttggatatagttgccagtttgctgattccctcacatattctcagaccatctcatctacagggaacagcctcccgactcggagcctattggcctctgctcaaccaggataatccctcccagagagcccctcatcctgcttcaagctctaaatggaggaatgttactttttatgccaaatgccttattttgcccatgcccttccttattttcttgagcatattccttctatccaaagttaaattctgtgataattgttggtttccattatttttattttttatcctcagtgatttaattttatcatacaagatctatcaaatattttccatgttttaagttgtcctgaagcagatccacgttattaatagactaattttaatcttgacaaaatcaaatgcaaagtgatcccaagtttatttctggttctaaatgatcaaaaagaccatcatatttctggcttatctcaattttctctcatgtggcttcccttgtctagtagcttttatatttgtatagtttcattttattagctgataacaactctttggttaagggtttggtgggataaaaagtttacatatgagttaattagcctttttttttggtgaggaagaaaacttaaatattctatgaatccatattatttctagtttccttttgtaccaggtcaccaagttataaagcaggggtgtctaatcttttggcttccctggtccacattagaagaagaattgtcttggaccacacataaaatacactaatattaaccatagcttatgagctaaaaaaaaagaatcgcaaaaaaaaactcatcatattttaagaaagtttacgaatttgtgttgggccgcattcaaagctgtcctggaccacatgcagccacaggccatgggttagacaagtttgctccaaactaaactatacaccttattctaaaattgcattaaatgaaacacatggcatctaaccacattgatctttgctttagaaagtatttcaaaatctttcaagtggcacacttcaagatgtgacactctgatggtcactataaatgtcaagttagcatgatagtgaaaatatgccagaacactcatagcaggagagtttagtaataatagctactatttattacatgccaactatgtatgaatatttacacccttacctcattcaatcctcacaccacagagataatgtgagctgtgaaatgtactctactctcaagcacaggagctatgtaacttgtccaaggccactcacatatctagtaagtggtagagttgagctttaaattcaggcattttggtttcggaatctgtgctcttgtgcactaatctgtattgcctcttaattactacaggattctcaaactttggcatgcataaggatcatcttggggagctgccaagatatatcatcactcactctaccaggattactgttctagtacagtataccgaaatatactctagaaagggaattagaaaatttttgtgtgtgtgccccaaactagctatgtgacttcagccaaatcacttgtattcgtcagggttctccagagaaacagaactaatatgatatgtgtatatacagatatagagagaaagagatttattattaagaattggctcatgattatggatgttggtgagttcaaaatctgtagtgttgactggcaggcagagacccaggagaactgatggtgcagttgatgtctgaaatcagtcttctccagaattccctcttgcttggggatgctggtctttttgttctattcaggtcttctactgattggataagacctacccacattgtggacggtgatctgctttaccccaaatttgcagacttaaatgtgaatcccatccaaaaaatattcaccaagttgacacataaaattattcatcatttgactcaacccctctgagttccatagatcaaatctcattgagaagatcaccagggattgggccagatggttataactacataatagatgcaccaaagtggtgaccagtggaacacaccctgaaaagtgatgactttagtttggctcatctagagttgtttttttaaagcaaccagtgtttaaaaaaattgtttgaattaccagaagttgctaacaagttctacataaaaatctgtatttctagtttcttgggaaaaaaaacaacaacaaacaagtgatgatctggcaacactgcatgacaacagtgtagctgagccacagatgctacctgtaggagtggcttgcaacctcccaaatgcctaccactcctcccatttcattcgcctggttcattgcacttatttctgtgtgcttcagagctcttgtaggcgtttaagtttttaatccttgcctccatagctactaaacatctgtggcacctccacctctcaattataaatgacaaagagagaactaggatttctgtaacacagtgaatgcccgagcttgggctggaaaacagagctatctcttcattgtgagtgtgtgtggtttatcaccgttcccagagttcccttctctgggttcctcagatcactgccttctttcacattaataaaaaacatgcttttatattcctgcatacttctttttcataggaggtgatagaaattgtgagctgccttcttcagagtcactgagtggggtcactagataaaaagatggaggaacattgatgtaagaatagaagctgctaattttgcatggagttgagttagttcatgaagcaatttcaaatgtaagaattactttccttttagcaaggctggctttataggaaaacagaatgatcagtctaatagtaagatttcattttacatagcctcattacttccccacttgttccctgaatgctcaaattacttcaaccaggacaaatagcagttcatatagcagagattgagagtagcaacacatggcttaaattgacaaaggaacaaaatggtgatattagagccatactgcaaatacattttggtggggggactagggaaaagatgaaaccaagggacactgtatagtctgaaagctgcagaagggaaaagtgtacaataatggagaagcttagaggaccaagatttgctttaccatctgtgcagtatgactggcacagccacatcttttcttttcatgttaaaatgtctatggccgtttttggggggacaaaacagatacaaattgtcattagggaattgagaattaattcaatcagccatatggtttgcaaacaagctttatttttctgtgtttaaaaaatgcatttaagatgtatagcattattatggtttctctagaagtcatccttcataaaagtaattcggtaatgttagaatctctgtcagtttcttggcaaatagtattcgattataaatttatgctccacaggacacacaattttagaaatgttctggaatgtttccaaattttattttggaacttggcatttggtttctctttaataatctcaatcaataatggtttatactagtcataaatgtattagctttaaatagctgccatattccatttcagtagaaatgcttttccctttcccatagtgtgtatttgaatattcatttttgtgtgcaaagttttttccttgatacttggattcctgtggataaattatttgaaggtcatttgggaaggtggagagagagagagagagagagagagagagcgagcatgcataggttttaatgtctaacattagattttttgcttgggaggtgtatgcttgcctctagatttttcattcttagaacattttctattactttttatttctattaattttgaagatatcaggatcattattaactctagccagttgcttatttaaattttgaatagatttatagcttttttatttttaaatctacttaagagtttatttatatatcccttttccttgaaatcatagaaagagaactattatacttaatactagttttgtgcttcctatggtatcttttggaataaccttagtaaaggactgactatagctgctggaggattgcttattatgcttttctgctaggaactgtagtcttattaatatttggctcagacaaaataagcttaggtcctagggccatggcagttaacgtcttttttctccaaccaaataatagactctatgtgagaggtggttttggaaatgaaactttagaccttaggggttgttttgatttacaggataggtgataatggtgctttctcctggaacaaaggatgagatatttcctgcctcttcaactgaggtaaagaatggaaagtaacaagaaatatactgtgttttagaatataaataaatggactgggaggaaggctgtatctgtttgaagtagttattctattataattagtaacaaaaataatttgtatttgagtaatataagtgatcaagctatccttggaatgtatatggcatagtatacagtaaagttgtttttaatgagagaaaagtatattgtaaaagactctatgccctcagaatagcttgcagagtttgttcataactcctttatcttaactcttatcctccttctccctttaaacatctctaaacacaaaaggaatgatggtacatgtattaataagtcatttaggatgccaatgtagagaccacccagcatacctatgagcagactgctgatgctcagagtcaccacttgcagtttgggacatttaaagtggagtaaaatataaatggcttatctgtgtgaccacttgattaaccacaggtggattatccttagtgacttcaaaatttatcgttagtttttctcttcaactcagagttcttctggatcatccatcactgtgtggtaactaacgtaaactaattgaatttctttttaatttttaatttttgtgggtacacagtaggtatatatatttatggggtacttgagatatttcggtacaggcacacatgcctaataatcacatcagggtaagtggagcatccatttcctcaattatttgccctttctttgtgttacaatggtccaattatacttttagttattataaaatgtataatacattattgttcactgtaggcactcttttgtgctatcaaatactaagccttattcattctaagtatgattttgtacccattaatcatccccactccccattcccccattacctttcccagcctctagtaattatctttctactatctccatgggtttgtttttatttttagcttccacaaataagtgagaacatgcaaaatttgtcattctgtgcctgacttaacataatgccctccagttctgcctatgtttttgcaagtggaaggatatcattcttttttatgactgaatagtacttgattgtgtatatgcaccacattttctttatccatttgtctcttgatggacacttatgttgtttccaaatataggctattgtgaacagtgttgcagcgaacatgggagtacagatatctctttgatatactgatttcctttcttctgagtatacacctagcagtaggattgctggatcatatgttagctctatttttagttttttgaggaacctccaaaccgttctccatagtggttgtactaatttacaaccactatggattgtaccacctatggatgaaggttcccttttcttcacatccttgtcagcatttgttattgactgaatttggttaaaagccattttaactggggcgagatgatatctcattgtagttttgatttgcatttctttgatgatcaatgatgttgagcatctttttatatgcctgtttgccttttgcatgtcttcttttgagaaatatctattcagatcttttgcccatttaaaagtcagattgttagattttttcctatagagttgtttgagctcttacatactctggttattaatcccttgttagatggacagtttgtgaatattttctccccattctgtgtgatgtctcttcactttgtgggttgtttcttttgctgtgcagagctttttaacttgatgtgatcccatctgcccgtttttgctttggttgcctttgcttgtagggtattaatcaagaaatctttgcccagtccaatgtcctagagagttttcccaatgttttctggtagtagtttcacagtttgaggtcttagatttaagtctttaattcattttgatttgatttttgtatattgtgagagatagggatctaatttcattcttctgcatgtggatggctatccagttttcccagcatcatttattgaagaggagatcctttccccaatgtatgtttttgtcacctttgtcaaaaatgagtttgctgtagaggtatgaatttgtttctgggttctctattctgttccattagtctatgtatctgtttttaaaaccagagtaccatgctgttttgtacagtaccattactgtagctttgtagtataacttgaagtcggataatgtaatttgtctagttttcttctttttgcttaggttagctttggctatggtgtgtcttttgtggttttatataaattttaggattgttttctctctgtgaagaatgtcattggtattttgatagagatggcattgaatctgtagatttctttcagtagtatgaacgttctaacagtattaattcttccaatccatgaacatggaagaatctttgagttctttgtgtccttttccatgtctttcataaatgttgtatagttttcattgtagagatctttcagttttttggttaattcctgggtattttattttattttatttgtagctaatataaatgggattgcttcattgatttatttttcatgttgttcattgttggcatatagacatgctactgattgttgtatgttgattttgtatcctgtaactttacaaaatttgtttatcagttctaatagttttttgatggagtcttcaggtttttctaaatgtaagatcataccatctgcaaacaaggaaatttgacttcttcctttccaatttcaatgccctttatttctctcttgtctgattgctctagctaggagttccaattaatggtggtaaaatgggcatccttgtcatgttccagatcttagaggaaaggctttcagtttttttgctgttcaatatgatactaactgtgggtttgtcttatatggcttttattattttgaggtatgttctttttataccctgttttttgagagtttttatcatgaagggatattggattttatcaaatgctttttcagcatcaattgaaataatcatatgttttttatcttttattctattgatatatcacattgattaatttgtgtgtgttgaaccatccttgcattcctaagataaatcccacttggtcatgatgaatgattttttaatatgctattgaatctggtttgatagcattttattgatggttttattggcctgtagttttcttttattgatgtatctttgtctgatttttgcatcagggtaatactggacttgtagaatgagcttggaagtattccctcatcctctattttttggcatagtttgagtaggagtagtattagtttttctttaaatatttggtaaaattcagcagtgatggcatcaggtcctgggcttttatttgctgggagactttttactacagctttgatcttttgtttacttgttactaatctcttcagggtttggatttcttcatggttcaatcttcgtaggttgtatttgtctaggaatttattcatcttttctaggttttccaatttattggcatatagttgctcatagcagcctctcatggtcttttgaatttctgtggtattggttgtcatatctcctttaacatctctgattttatttatgtaggtcttctgtctttttttcttaatctggctaaagttttgttgattgtttttaatcttttcaaaaaatcagcttttagtttcattgatcttttgtattgttttcttcatttatttctgctttcatcttcactattttttcctgctgattttgtgtttgggttgctcttgcttttctaatctttaagatacactattagattgcttatttgaagttttacttcttttttgatgtaggcacttataactatacatttcccttttagcactgtttttgctatatcccataggttttagtatgttgtgtttccaatatcacttgtttcaaaaaaattttcagtttccttcttaatttctttattgacctattggccattcaggaacaggagcatgttgtttaatttccatgtgtttgtatagtttccaaagtttctcttgttaatgatttctagttttattccactgtggttagagtctcacccaaggcccacagcatgtactacctggctaccactcttgactattcagggcccaagggctctttagtcagcagatgatgaatcctgccaggactgggttcttcccttcaaggaagggtttttcttctggctcagggtgtgtctagaaatgtcatctgggcatccaggagatagggcctcagaactctgcctcatgccctatcctactatggctgagctggtattcaagttgcaagacaaagttctctttactcttccctctccactcctcaagcagaaggaaggagtctcttttggagctgtgagctgtgttgcctgtggttgtggaagagatggtgcacatgagctggtctcactaggtcacatgcccccaagttcactgtctctgagcccagcacagcaccaggactttcccaagaattgcagtccttgtggcctagactgcctttcaagtttatttaggacctcagagtactttagccagggtgataagccttgccagaattcaggttctgacttctgggatgggtgattcccttttggctagggctggcctgaattcaccctccattgagttttgcctgtattgctttctgctgtgacagggcaagactgagtttcagtgtaaagtctaacaatcactgtgctctcccttccccaggcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagatggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataaatgaaaaggtaagaaatccagaggaaaaaattacatattctctcttagtttatttttattatcaataaaatgtcagtgccctttaaatgctgaactttatcatgcatatgaactttgaattatttttgttcagaagagagaaacatggaaagaaattatatgctccctcatataactcaaaggcctgatccatcaaagctagaaaagttattgtcatcttgggtgacttttgatttctcccttgttcttgtaaggcctactctcttccactcaccaatatcttctagtagcttccccctggtgatgtgtggctggctgagtagcttcttgagaacatagccattattgagcttaattgtctttcacttattattctagtgacattctattacctcaagataacatacaagtctaatttacctaagtggatactgcttttgtgtgttacattatgctttagaatttcaaggttctgaaattattttatgctttttaggaatccaaaaattaagctgttttctgttattttctttaatcttcactagtaaatgagattaacatgcatggaaatctggccttgggagaactaaacccaagtggtcacataaaacccaggaactatgtcagccttaaaaggccaatccatcattcctagcaaggtgaatgtaccacacagaattatcagagatccccccttacaaaatggtaataacaaaaatatttgtcatttttggggtactttctaggtttccttataaaatgataataacaaaagtattcatcatttttggggtactttctaggtttccaactctttagagatattattctaaggcaattaactgggaaaatagaaatagttaaaaatcactttctttgcattgaagggcttccagtataccatggtgctaacttaattctccagttttagtttccattcctctataaaaaattattttatctaatcagaatggtctgtttctcaacaaagcagtctctcaataccagtacaggatgctgattaggaaattaaaattgttcttctggagactatctttggtttttcactgaatttcttattctactggacgttttcagaacatagtgcaggtattagtcactgcagattactccccttacccctcttctgagatcttagaatgttctggatgatctgatggctggttcagagatggctgttttataagttaagagtaattcatttaaaacagggtccccaacccccagaccacggtctggttaggaaccgggccacacagcaggaggtgagctacaggtgagtgaacactatcgcctgagcagtccacctcctgtcagatcagtggcaacattagattttcataggagtggtaactatttgtgaactgcatatgcaagggatctagattgtgtgtgccttatgagagtctaatgcctgatgatctgaagtggaagagtttcatcctgaaacaacctcccactctggtccatggaaaaattatcttccatgaaactagttcctggtaccaaaaagtttggcgaccactgatttaaaaggacaatttacacaaaatcaccctcaaagtgcatgtgtgagtctagcatatgttgtagtgtacattttttatagggtgtgcatagtggcaatatgtcctctataatagagttgagatatctgctttctcaaggctagactctgagttaattaggtggagtgatcctcctgatgtgtaagacagttccaggcaagtgctatttatgcctgcttctccattggtgccagcagtaacttgactctccccttaactccctaagccttttatctctctcttactgagagctttcatcacctccatcctgtgttgtagatctagctatctactctttttctcccttcttgtttttcacattgcttgactcataatgtttgcttaatacatatggtaatcattgatattgtacagcaaatatttccagctctcagtcttctgagcagatgataagattgtactttccaccatctttggccaaatgactcactttgaccaaagaaatgtgatcagaagtgatgcaaattattttcaggtgaaatcatttaatagccactgctcaactcctacttttccttcctattcactgtgatggtatgtagagatgaagtctgagtccctgaatgactgcaatgtccagagtctcctgctgacctgcaaagtgcatgtagtttaaactagaaatatacttttgattctttgagccattgagattttggggtggtttgtatacagcataacctgacttattctgacaaatgcactggacctgtactttccaatatgatagccaccagctatatgtggctattgagcccctgaagtatggcatcttatttcattttctgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagtttaacatttaacaaataatgccgttctcaacatgaagtttgtttgtatttttgtgtttaataattccttcttgtaattccgttagctaaagaataactcaaatctttttcaatcatcagataattgaatatcatattgtgatgttatgtttatgctataataagaaggctggggttatgcccattaaatacttctcctgatgaaattttttagcaaggtcactccttatggctaacattttcttatctttgtaaaaataacaaagaagtccctgtttgttcagtcatagttgtgacttttatttcttttccaatatctgccacttaggatatttattaaattaggcccctttgcatggggccttgtgctacaaaccaaaaggaaacagaaaaagagaaatggagctgccatgaagtccttctgcagcatcagctgtggggactgcacatgtgaggaagcagttctttggatttttagatgagtgagacagaaagtaaaataggtggtaaaaagagtcactgaaaggaacaacataccttaacaaataaagggtgggggaaacacaaagtaccaaataggctggaaaacatcttaagcacttaataaattatagctattgccatgaaagtgtacgaacccagaaggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagcatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagctgattcaggtcatggtggcatcttatctgaaagtgaacatttcttcagaaataaaaaatgcttttgtaagattatagaagatttgggaattatgccatgagggcacatgctgagtaatatgtttttgaggcaggctgccaagtttcgtcaaagaaaggcaagtacagggtttgttttgcaatgtctggaaaacttggaactctaatttcttggaaaatctttccaaaataaattcagtatgaaggcattctacctcaacaaattacatgtagcaagaggaaaggaaaaacaaagtgtaacaagatgtgagatgagaaaaggagattttttttccccaagagatgcgaccttgttgagttcaattacatgtctgacagcatcagagaaaacatcctcgtaatgttaattttactcaaactcctgagtgtgggtaaagtaaagaaattatccttcatcatcagttcacttttatccatctttaaaaatgtacaaaatataaggtgtcatatatccaaaaatattctgaattgctggagatcttcagcaagccgtttacattttctgggtccatttttctcctttgtctaatctggagggtttagatgtaaaaagtgctatggtctctcctaggtttaatttttttaagtaaaacaaattattatttttgacatattcacatactctttgatatatgtcagcaaaattttttccttatcaaggtctaatttttatatggtgtgaaaagcactgtggttacttcatagacatgatcgaaaactaggaccttccccattgtcccttccagttctccatacactttgaagcctttgcatggttgtcagaagggttgtagtgattgataaacaggaagaatccaactgacacaggttctgtatcaatgagatggctgtgcagagcaggagacagcaatattctccccctggcaaggataaactacccttgtcctcaagtcttcttggagctgccctgctgctggtgactctgcctaatgaggtgggagatctgctcaggttctttaagaaacacaatctgggtcttcatgaggcgagtccctactgttcccagaggctctcagccacagtagtgcatggaggtatgaactaagaagctgtagaaggatacaagtgcactttgcttggcgactgcttaccaccgtctttccttatgggcttgggagctggtggaaaccaattcagcagatttttgagtgacttttgaattgaaggtgaattctaggagatctgactgtcccaagtaggatgatactttaagcctttctgatgtgtttaccataattcaattgaagaacatttatgtatagtttattcatgaatcctacatttattgagtgcctgccctatgccattttggtggggagaagtataaaaataataaaaaagtataatttagtacagaatgactaggtactaattaaaattgagacagactcatagaggaggtaacatttcactcttagtgaaaagaagagcaagccatgaaaaggtttgatgtcaggatattccaggagagggattggcaagggaatggtggggaggagcttcacatgttcagggaaaaggaagaagtccagtgtggccggagtacatgagcaaaggggagcatgacaggagttgaggtcagggaggtgggcaggcgtgaggtcaagtgggccttgcaggccatggggaaaaatttggattttattgtaagagcagttaaccattagagggtttaaacaagagaatgataggccctgatttgtatactcttcttggttcctctggctgctaggtgaagaatggatagtggaggagtagagagaatagggaattagttatctagtcatccaactgagatgtgatggtgactcagacaaggttagtggcagtggagaaggagagaagtgtcatggctttgggatgtatttcagagtagagctcacaggacttgctgatggctgcctgtaagagaataagaaaaggcataaatcaaggaggattcctatgtgttggacttggaaaaactgggtgtatggtagggctatttatgaggagggagagacctggggaggaactggtttggagacttaccaagagttctgattttgccatattaagtttgggtggcctaatagatattgaaggaaagatatcagacaggcagcttgaattgctatggaaagtcctgggctggagatttcaatttgggaaccattggcatggatctgatgtgaattgtgaaaagataagtaaaagtttaaaccagtcctgtaattcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaagattgcttgaggccaggagttcgagaccagtctgtgcaacagagtgagacccccccatctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcaaattcatacctttcttctccccaaccataccttcctagtacactctaggattctattacttacacagacctctcattctttaacttttcccttaatatttccctacactcttgccaaaactcactcttggccttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattccactctatcctgtgtaccacacttcttccatcttacattcaactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcctggattccagtgattctcctgcctcagcctcctgagtagctgggattacaggtgtgcaccaccatgcctggctaatttttgtatttttagtggagatggggttccaccatgttggctgggctagtctcgaactcctgacctcgtgatccacccaccttggcctcccaaagtgctgggattacaggcatgagccactgtgcccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctatttatgtaccccataagccaatcaaaatggaaatccctggctattcttttactgctccccagattttcccacctctgtctttgttctctttctctgaagaggactacccctcaactctgcaagtgaaattactgcacactttaaggtctaactccggtggcacttcttttaaaagctttcctggcctctctcatcctcagcaagaaattatagtcttttccgaattttgtagtagattatcttaggttacttgttaactctgtatgatattttttattgtagagtaaatccgcactttgttcatatgttcttggaaactgtgaagttaagtgaaaccaattttaccataggctgattgatataaaaagttaagttcaggccgggtgtggtggctcacgcctgtaatcccagaactttgggaggccgaggcgggcagatcatgaggtcaggagatagagaccatcctggctaacacggtgaaaccccgtctctactaaaaatacaaaaagattggccgggcgtggtggtgggcgcctgtagtcccagctactcgggaggctgaggcaggagaatggcgtgaacccgggaggcagagcttgcaagtgagccgagatggcggcactgcactccagcctggtcgacagagggagactccgtctcaaaaaaacaaaaacaaagcaaacaaacaaaaaaagagttaagttcctaaggcatatttctggccacaaaaacatcaccaaaactcgaaataagacaaaacacttctaacattaaacattaaaataaatgtaagctatacatacatttaagaaagatgaataaaaacaagtaagataattatttagacacttcttccaaatcagagttgtgagtgatcagagcctattctggcagctcagcgtagctcagggcacaaggtgggaaccaaccctggccaggagccattccctcccagggtgcactcagacacacacccacactcactcagactggcaccatgcagacacgccagttcaccgaagatgcacgtttttgggatgtgggaggaaactggaataaggggagaaaacccatgcagatatggggagaacctgcaactccacacagacaatggcctcgtctgggaatcggtttttgttctcatcaacataataacagagtgacgctattcaaggacctgctgtacatccactgtggattgctctgtaggcccagttttcttagtttccactaatatcatttgaacaatttttcagttgcttggtgtttgattgttttagttgtttagacttttttccattttcctgacctatgatctcacgaaagctaatagtatctgttatggacttagaggacatccggcttctgaggccctttgggactgtacatgattttgcttggaaaaagcccaaatactgtaactaaaattgttcccgtggttattttgtccaattgatatgaggttgtttttgtctttttggttttgatgcagtgttttggtagaaaaacatagcaaacaagattttactaatatcactaagttaactttgaggtacccagttgttgctaacgtagttctctacatcaccaaatattactgatcccaccattacaagacctctgaaatctatccctttctctcccttcacactgtaggggccggatttctgaccctcaccacctctctgccaccagcttcatcctactgctatctgtctgcagaagaatcatctctggtggggccacttctctgcttacgcacattttctgatttcctattgcttccagaattaagtccaagtccatttgtgggacctctgagtccctttagattcaaatcccagttgccttccccaggttcatctcttgtcacttgcttagctgtgtctcctgtccccagccacattgagattttcactactcccagaaagacccatgttcttctggggcttgaaagatccctctaatttcttcccctgacccattcccattcattatttaataaaaactcaagtattacctcatctgtggtgcctttccctacttcctcagagagcagccccctttctgtgttcctataccattcattcactcattcacatattgaaatccaggtagttaaaaagtgctgggaattaagtgacctagaaaccttagtccctggactgtaaggggctgtatagggatgtaaaaaagaaaatgacaacattgagggcagggaggggaccaaattagagagactccatgcattagaacaaactcgaggagttagtgcctgactctgtgtgtgggaatgcagaaagcggaagagaagagaacaatccccatattcctgccttgaatgacacaggtatgtggctgtccatggacacaggaaatgaaaggaaggagcaggcgaggtgggaagtgggaccagtttaactttgaggtgactttaggacatctgagtgatatgtccagtgtgcaatgggatttatggatcaagagctcaggagaggaagcggagattaagttaagtttctgggaggttccaacaagcaaatagcagttgatgttaggaaaatttctgaatttaccaggtgctccatgcccttcttttgttccgtatcatattgtatatctggtgacatagcctgctttcccataaggacactcacttattaattcacctcgtatcctcagtgtctactacactgctttgcacataaaaatttcatttcaagtgagagaatgaatatgagttcactcagccatgtcttactcatgggtgagagaatattgaaattgatccatttaataaataatgtattgagcaccttctatgtactgggaagtctcctggccactggaaatacagcagtgaaaatgatagtgggggaacagtaacacagtaaataagcaagataatatcagatcataaaaatgatcatagctaatactatggagttcttattatgtgtcagggcctgtcctgagcatttaacatgaattttaaaatttaatattcacaatatcttataaggtagggaaattaatcgagtaatatggtggcaaatggtcagagaaggctgtttgcagttataatggagctgaattgtgaaggagccagcctcaatgagatctgggggaaggatgtttcatgcacagttcaagtaaatttaggttttattaggttcgtttttgccattaaaagtaatggctaaactgcagttacttttgtaccaatctaataaaaccttcttcttttaatgtgaaaagaatacagacttttcttaatcactgcaagttgcattcactagccttcaaatactctacaccttagttcacctacaaccaatcaaactagcagtagttaattgtagaatctaaggttagggcaaaagacctttccacgtacattaagacacacatgtagcttgtagtgagtggagattggggaattttacctcatttgtactcactaatgtattatgataaagatcaacaggaaaatgatatgaaaacacatgtagaaaaatgatttagattctaaggtagattaagttaggaaagagcaaaatcataaagatatacctactttatctgctcactcaatcagactaaattcttaatggaaaagtttcttaggaacaagcaaatataaacaattactttttaattcatttttcctgatctgtataggttatttgcatgtaaatcatattgacacacaaactttactttgtcaatcatttagggcaactatgaaaagattaatacagtagttggacttttgattttccatcttgttcttacgtagaatttttgatgagactgtgatggctaaagggagggaggaagttcatcaagggcccgaaatgtctgtctgttattagaaaggagccttcattttccagaacgaatttatccatagcaatctgtaaaataaatctgtgtagaaagacgtctcaaactaggcatgataaaagttagggccatactgcaggaaagaagcttagaaggatcttctcatccagtgccctcagtttataacccaggagaggccagctgtcttatctaaagtcacaacctagaagggatgagattctgggtagcatttcttgataaacttgcatatttacttagaattatgcattttaagcttatctatgtattttaattattttaagttagaaaactgtaatatagttttaatttttaaatataattatattttattgccttaagtttaatagtttaatagtttaatttatgtgggcattttgtatttaatcatgggaaagtaaaaactgttataattcaatttgatttactgaattagtgaataaatttatttttgtctgagtttttattaaaagagacgaattttaatcaatagaatttatgtatatatatatgtatatatatatatgaaagtctaaaattggaacaaaataaaaaggtgatgcaactaggagcccctttgtatctctactgtcttttgggcttcctatttttgcattatttccacttttattgataaccaaacactttccaaatgttaagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatcacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtttgtttgcttaattttaaattggtaataataaaaattggcttataagtgaacaattttgatagattttagttcattatttagttcattatttgtaaaatgcatattttccttcccctttatccctgtgttcaaatgaggagttattatttgcttcaggaagcttctcttggggattaaataagcattttcttttcttttcctttctttctttcttttttctttttctttttcttttcttttctttttttttttttttttttttttttttttttttttttttgagacagggtcttgctctgttgctgaggctgccaggctggagtgcagtggcacaatcacaactcactgcagcctcaacctcctgggctcaagtggtcttctcatctcagcctcctgagtagctgggaccacaggcgtgtaccaccacgcttggctaatttttaaaaaactttttgtagagacggagtctccctgggttgcccaggttggtctcaaactcttgagctcaagtaatcctctcgccttggcctcccaaagtgttgggattacaagcatgagctgctgcatcagggctaaataagcattttctataaaaggtttattagcataatatctggcctataggaaggatggaatttatgttagttgttgttgttgctactattattgccagaccctgtgctaggcaccgaagatagaaaggagataaaagtgtactatctcaaaaggatcaaagcctggtgatgaggcctgtagggatcgagttagaattacgattgttttctaaagatggaactttgtggctattttgtagtttgggtctggagccttctgccattttacacaccaggtctatgcatctgttctttaatgcaatacatagacctgcaaaaatacacaaaggattacagaaggtgaataaagagtagtatttccataacatagcatggaacccagcagcctctagttaaaaagttttactgtgcttcccaagttcttgatttaactttattagttgaatcttccatatgccttcaagggaagcataactgaaatacaactagcagttgtatttatattaagcttcatctagtttgttatcaaagtataatttttgctttgttgaaaattttttagatttgttttgattagtctgtgtagtgattaggcagatctgtggaaaacgggtactttccaatttcttgaaattctaaacatgttttaatggtttgtttcaacatgttttactttcaatgttttagtagctaaaggcgcattactgattagaagacaaataagctcttttgagttactttacaaattttcatttatctctcatggtaatttacaattactagagaacttcggttaccttaaaaacatttgagagtaatttttcttagcaccatagatggtaatgttgatatgtggaacaaaatcttcaatagtgactggctctgatttccaaggaagttgaaggtacattgaaaacattttcagtattaagaaaatacattaaaaataacccatttaaatatgctctactagatcctcaatagtaatagtatcatgttcacagtttattctgttaaatatttggatttttcaataatgggtttctttccttttaacagttttctcctgagtggtccataataccaacttgttaaatttgcaaaagagatttgtatttcaaatttaagtgcaagaaaaagctaatgtttctactgatgttgtttataacaagagagtgagaaggcccagtgaaactgtgagaagaatgatttatcttacttactgcattagaaatcggcctgttattacttcgttggcttctacaaaagagcttgtaaataaaatgttatagccctaattgaaaataaaaggatagtgaatggaatttagccctattcatccttttggatttaagcatgattcatttcagctaaaaattttaaaaatcctcactttcattatggtttttttttttttgtttgttgagacagagtctcactctgttgcccaggctggaatgcagtggtgcgatcattatgtacattttttaatgcaagtttaatgagtatccatatctcagattagcacagcaattttttgaggcatttagaaattcccagatgtactaccatgggcagctgaatgctttggtgcaagcgcaaggtaggatcagagcaacctagggtgaaatcctactagctgtgtaactgttgcccactagctgtataactctgagccagttggttaagcgtgtgaagtctcagtttctttacttgtcaaatggggaacaaaacaaccacctcacagggtagcttagagaagaaagagaaattcattatgtagagcatattgcagtgttttgttaattatacttggaatcctttttaaaaggatggcagtaggctgaattacattcctgcatggcagtaggctgaattcttacccagtttagtatcatctgatattgaatacagctcacttcatataggatgaagtgaataaatagtctaagccagaggagttggcaaactatagggccttctgcctgtgtttgtaagtaaagttttattgctaattaccctgatttgagaaacatgacactgtaccccataaatatgtacaattattttatatcaatgatacataaaaaagttgttttattgcagttcagccttgcttattcatttaagtgttgtctgtgtttgctttcatgctatcatggcagattagttgtggcacagaccttgtgacccataaagcctacaatatttactgtctggccttttacaggaaaagtttagctactcctggtctaagctgttgtcaggggattgcttaattgatattatgaagtgttgtggtttgcacaaatgagaggatccattttaagtgaattactgtaggaatagactacagcattacttagctatttttgggctcaccagagaagtccaaggattatctgtgattagtggtgagatcctctggaatagatgggaataaaaacctagtacctacagaagggcatttggacaggaccaaaaccttctgtggttcagtttcagagtggggagaagccagggagtgatattagattcctatatgacatcctttatcagcctacagctatggaaattgttccaagcattcattacaaagtggatttagttattcttaaaaggtctttgtgaatcatcctaaatcttaaattaaaagattgtaacccgatattactatgtagagaccctggaattaatgcattttacctggttattagagtagctgcttcaggtgccagagtaggcaaaactagacaaggctctgtgtgctgcaaatgactgaaggtctgaagccatattccacttaatttaatcatttttaaaaattattattttagagcagggtctcaccctgttgcccaggctggagtgcagtagtgtgatcatagctcactgcagtctcagactcctgtactcaagtggtccttccacctcagcctttgagtagctaggactatagtcatgcaccacaatgcctggttaattttttaaattttgtagagatggagtcttactatgtcgccaggctggtcttgaactcctggcctcaagcaatcctcccgcctcagcctacccaaatgttaagattataggtgtgagccacagagtctggcttcaatttaataattttgatagatttaacatcagatcaattgctggcctctactggaagttctgagaagtctttcatttttcataataagtaatattctaccatcccaaagtctgcttttctccttaattgatctttggggagttagacaatacaatcatcattcctgagagctatttggtgctttagagtttacaaagtgcttccatttacacaattttattcaaataacataatcaccttacaagctagaagggttggaatcatccgtatttcatactgataacaacttcaggttctacgaagttaagccacttgcctaaggccatacaactctaaagggtgaaggagggacttgatttgtcttctgacttcatatcccatgttttctctgccaagttattttgtctgatgttaactctccgccaagtttactgaaaaatagctaaaatataaagtctcattagtttttaaagtaagcatccagaggagagaacatagagaccttttcaccagaaacacgtatcatctagatcagagctggcaaactgttggaccataagtctcatctggcctgcagatgtgtttgacttagcctctataatatcggcctgtacatggctttattaaacaattacatggatttagctgttaagtaatatcacaaataagtccagatttccaacttctttagaaaagtcagatctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagcccttttttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcagcactgagactgagtttcagttttagaagcagaaggtgcctcatgttagataatagcacatgttaaagagaaactgagggaaagagcagtgatcggtattgcgggtatatactgagaaactgggatgagtggatgcaggagtggactagcactgtcagccacaagtaggagcatgtagaagctgagtgagaataggcagtttaaaggaattgacggtgggacctacccagtgataagaaggggtgtcagatatataaatgagctgagtgagtatagtgttgatcacttattttatttcaatggcttttgaggtacagtggtttttggttacatggatgaattgtatagtggtgaagtctgagattttagtgtacctatcacccgagcagtgtacattgtacccaatatgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttgtttagggagggccttgacttccaggctagataatttgcatttcaaagagatggtttccaaaactgaccaagtgagcttggtgctaagatcataatatacatttaaaagtgttttggttactctggaggctgaggcatgagaatcatctgaacacaggaggcggagtttgctgtgagctgagatcgcaccattgcactccagcctgggcaacagagtgagactctgtctcaaaacaaaacaaaacaaaacaaaaaacaaaaaaaaaagtgttttgggatggattactttcagtggagtttgtaaaatgcctttgtgaatagctgcgatttagaaaacagcttgctcaggagagaatcaaaaccttcctaagcagaaataacccctcagacttgcacctggagtccacttggagattctcccaggtattacttaggatacacagagactaatatacaaatgaaggaaaatgtacagatagtgcctactggtaatagattacagttggagaatcccattttgctaaagatagtattgagtctggaatgttatttaattttcagttcctgtataggcctatggaagtcaccttatattggagtctttatagagtctctcatgttacagggcgctgctcaattaccttattttgagcagcagaccacttgaggaagacacattagacctaaacgagctcatcagagctatttttatttgctcatagagatgtagctgacatgatgggtaaaaaaaaggaggcaaataaatggaatacagtttctgttattattcctagagatatgagtttgcaattgcaggtgctggatataattttaaacatgccttttaaagcaatgcagcagatattttgtggatattacaaacatacacctcaggacaaaaggaaagctaacctaatatgactggaattcaaggtgtatggtaagatttccagtgagggtatgtattagtccattttcatactgctatgaagaaatacctaagtgtggttccacatggctggggaggcctcacaatcatggcagtaggtgaaggaggagcaaaggcacatcttacatggcggcaggcaagagagagtgttcaggggaactgcgctttataaaactgtcagctctcatgagacttattcactatcatgagaaaacccacccccatgattcaataaccttccacagagtccctcccatgacacataaggattatggcagctacaattcaagatgagatttgagtggggacacagccaaaccatatcagggtagattcagaaaatgtttctctaacagtttagactgatgcaaaggtgtactttttggaaaactctttgatgacttaaagtttaagtggaaatgtagagtctggataaaactcatggaatttatagcattccaagattaatatataattttataggatgtgttatagaatatggataattaaattaattatataaccattaggtttgaacaagtattaatcctggagggagtgaaggttaattttacggtcaatttgagtgggccatcgggtgcccagattaaacattgtttctgagtgtgtctgtaagggtgtttctggatgagattagcatttgaattggtggactcagaagacttccctcctggtgaagtcgggcatcatccaatccattgagggcctgaatagaacaaaaacaaaggaaagagaaactcaccctttcgcttcgtgccttcttgcttgagttgggacctctcatctcatcttctcctgtccttggactgggatttataatttggctcccctggttctcaggccttcacacttagactgggaataccactggctttcctgggattccagcttgcagatggcagatgatgggatttctcaaactctatagtggcatgagccaattactcataatctctctctccacttccctctctcattctctcctttcctctctgtgcatatataacctcctttggttctgtttgtttggacaactctgacaaatacagatggtcattataaagcaactttatttttgtcacccacttttgttcttttaaatttattctgtgctcctacttattattgttctggtttgaaatttagacacagcctcatggttcttccagtcacttctacttccactggaagtacagtctgcttagtatatttattccaaacttcagaatttattgaagttaaagcttcccctttctcccagtgcaggactgctgcagacgagccctcattagtgggagatgtgctgagaagcccttctctttcccactcagtgcttctacttcctctcatcctctcctagcttactccccttgaagcatggtggggtatgtcatcagagtgaggagaggttggagctgaaagcacccactgtcttctgtggggcctggaaatctctccctcaccggagatcgctcatctgtgcttgtcttccatgggtgaaaacatttctcctggttcgtctctcctgatgctttgctcagctctgcacacaacttcagtttccttttgatgaggccccttgcttgcttctcagcattcattttttttttttatgattagcaagatttttttaattatactttaagttttagggtacatgtgcacaatgtgcaagttagttacatatgtatacatgtgccatgttggtgtgctgcacccaccaacttgtcatttaacattaggtatatctcccaatcagcattcatttttaaaactgtggcaaaatatatatattacaaattcatcattttaactattaaattaaattaatttatttttgagacagggtctcactctgtcacccaggctggagtgcagtggagtaatcatggctcactgcagccttgacctcatgcgctcaggtgattctcccacttcagcctcctgggtgtctgggaccacagacacacaccaccatgcccaactaatttttgtgttttttgtagagacagggttttgccatgttgcccaggctggtctcaaactcctgggctcaaccaacccccctcctcagcctcccaaagtgtcgaaattacatgcatgagccaccatgcctggcaatttcaagtattttaaagttataattgtgtgattttaagtgtatctatagtgtagtgcaaccatcacaccacacatcttcagaactttttcatttccccatactgaacgctgaaactgtactcattaaacactaaccctccatttgctcctccctccagctcctggcaaccaccattctcctttctgtttctatgaatctgactactctgtaacctcacataaaataaatcatatgatatttgtctttatgtgactggctgttttcattcatgttgtagcatgtgttcaaaattttcttgtttttggaggctggataatatccgcattttgtttattggttcatcttttgaagggtacttgggttacttccatcttttagctgttactaataatgcttctgtgaacataggtatgcaaatatctgtttgagtccctgttttcacttttttggggtatatacccagaagtgtaattgctggattgtatgacaattccatgtttaattttttgaagaactgtcacactgtcttccatagtggcggtaccattttacattcccatgggttccaatttctgcataccctagccaacacttgtacttttctgtttttatttgtttgttttataatagcaatcctaatgggtgtgaagttgtatctcattgcggttttgatttgcatttccctagtgactggtgatgttgagcattttttcatgtgctttttggccatttgtatatcttctttggagaaatgtctattcaagtcctttgcctgctttctaattagattgtttgtttttgttgttgagcatcagcattcttgggtaggatttctggtgaccctgtgctggtccctgtgtgctccatcatcagggtcagggaagcatacagatggcacactccagtggaggaactgaggagagcttggtgaagagattattctcagaagtgtgggcagtgttgagatactaacaagggatgttgaagtgccttgtgtaacagtgtagagtcattatcacccctgggcctgaggggacaaggagaaggcatgaggacagagagcctagagagagctacatctgcaggagaggactgcccagcagaagctgtcaacttctctagaacctgtgctaacccagcagggagaaaactggggggataaataccccattctctctccccttccttgttcttgtcttctgcaggtgcctcctgttggacaaatgtagctggaagtctgtgataatttccatcaaggtcagtctcttgggcatagagcaggatagtaacaggtggaggctgggtctacagtggtagacaagatatatccagcacatgagtggaattcctctttggtccacaggatcttctacccattgttgggagtgcagttacttctcaaaccacaggcttttctctgctgccctaggctgcttcagtgagtcacttaccctttagggttctcaagagtgtgagttagtcgccattccaccacaaccaggaagcatgtgagctctaaaaattccactgaagctccttactctaggcttgaggtgagggacaaattcttccccaaattcttcttgcggggaagatgagactcatagcacaccagtaactttctccaaatagtcttctgtaatctccaactacctagacttttatgccctcagtagagatgaggagaagggtaaaatctaggaaactgcaatctttacgcagtcctttcacacctcactgtgaaatatgctggctatgggctaggaactttagcagaaactggggctgaattggttgtattttaacatcctgtaacaaacatcatatgcagtccatatccctaaaagtttgtatattttggtaaatataaacacatttttaagaaagtcatctgagtcagaaatgggaaagattgctttatatttgggattacttcatatttggggatataagatatgctttctttgacattttcccaatgtagaaacacaggccaaataggataactcatgaattccatgaaatttatccaagtatctcttagctttaagtagctaaaacctaaattaggtaaatgaaaatatttcaacatttggtaaggtgtgcctaaattaaagttcacactagaaacattcttgtttaatttcaggtgagttcagtagagtagtttccttggcataaataatttcacatctaactgtttatacttttaaatgtattttaattgtgaaggcctaatttctgaatttagtttagaataaacctctagccattttctttcttatgtatgtgatccccaaagcagacgtgtcctaggcatcagttttcttatctaatcagagaaccagtgaagaaaggaggaacctgtcatctccatgcagaagcaagggattaagtgattaagctgtcatttctcaaagcctttctccaatgcttgccccataagttttgggttttaaatgagtttagtggaattctgcagtcttaacatatggcacatatccatgacttcagtaaattacaggtactaacttttgttctttctggtgcagatgtgttatcattttgctctgttttgttttataatgtcagccttctctgtgttattaatgtagtgtcatgtgctaccattttaggtaaaaagctttttctgttatttcctatgaatctcctaggaatggacccatttggagaaccagactgttcattctttcctttccctccttttctcttcttccactccttcaaagtattggttgagttgctatattatgtgtcacaggcattgttccaggtgttggagaatctgaaatgaaacacaaagtccccctgctccaggagcttgctatcgccatccaatggaaaggaaagcaacaagtaaataaaaactgccacatgatatacatgtcagacaggagacacatggtataatgagaataccacaaaggggcctaatggggtgacccaaggtgggtcctgagggtttatgaggcaatagttccataatcaaggagaagaaaggcaaccctgggcggagagcacagcatgggaaggccaagaccagggaatccctggcatttgagcagtcaacaatctcagcgtcagccatgttcatggtgtggtacagtggtacttttgtggaggcatacattttaaattcatgccctgggtggccagtgtacaggaggaaatcacttaatgggggggcgtgtgcccagctggctgctggtatctgcttctttgtttggctctgtcttttgcttgctatcctagatgcaataactcctatgaaatgaaagcaagaactttctgtcttagtgacaaatggtcatcttatgagagttgaaaggttaaattgtcacatgagtttatgcacaggaaatgtgatttgggggagaaacaagtgcctctgcaaacatttttgtatttgggaagtggggatgattgcaaggtttatgcctgcagcgacagggagggggctgcatacatcatgttgtgtgaagagacggggcattggaggaagagcaggtttgttcaaggtgacgggcaagagggaaagggaaaggagggagaagaaagatggaaggagatgatgaattctgttgagtttgaagagagatccaggccagaaatgctggttaggaaggcattggtgctgcatggtagtggaagtcacaggggtggactaggtcatttgaagaatgcacagagagatgagagggctaaggaaaaatctgaggaacagcacagggcatttttagggtagtgaaactattctgtatgatactgaggatatggtagataaatgacattatatagttgtcaaaagtcatagaactacataacacaaagaaaactctattgtaaactttggaatttagttaataataatgtatcaatattggtttatcagttgtaacaaatgtaccaccagaatgcaagaggttaataataggagaaattgtgcagtgtggggagaggtgaatattgtaggagcactgtattttctgtaaacctaaaactgctctaaaaataaagtctattaattaaaaaaaaaagccagtgaagatcagttatgtgcatagcagctatacttctgcagaatctccttggtgagcgtgcttttttcaggcttacataatacagttaaaagaaagaaaaataacactcccctcacagagaaataatcagctgaacaaatcactagttatcagaatgcaggctgtagtacatcctgtttttctaactcctctaaatttactagtaaagcaacccaaattgcatggaggaggggaggtcattgcttgctgtcaaggctgcactaatgacattagggtggcattagcgtaccagggctctcctagtcctcactacaccacattttgaatgagttttgcttggacaagtgttgagggtgaggtggcgggagagggaaggagagagatagcttgtgctttgtcctattacctgaaccagactcaattgtcaaacatttttagtgtcgttttcctgtgctcacggaatcctgagagtgtagcactactgtggggagggcaggagccaacaggtatagctggcttatcccagcatttcttccttcccatctgtgcacagcgtaagtggcacagtccacagagtccgctcccattttctctcttcccccttaatggggcgggggcgtgagcccagctggctgctggtatctgcttctttgtttggctctgtcttttgcttgctatcctaaatgcaataactcctatgaaatgaaagcaagaactcaaagctcaagtggtcaaagctcaagtggcagccaagtggtttcttgtgatctgctgaggtcggcttctgataattagaagtgacaggtgatgactatgttatcataacctgcagccacaccaccttcttctggttctgagacaatgtgtagtagaaatggttatttgttcatcgagctggtccccacaattcacacccaaagaggccttttcatggccctgcacgcactgatggctgtttcaggtagacaagcccagcagtgtgggaacccagatatctcccattctgtgtgaaggagctacctagtttctggaatttaactagattagaacctcaagtgatgcattataggtctgaagaagcatgccaatcatgacctttatcttccattttatgaacccttggagtggagcctttagaaagaggaaacagcagagagagggccttaccttgtggcccatgtggtgacattttaggagctgcaaaaagggtccctttgcctcccaaaaagttccctgaggctgattcattcaattctatatttaatgtttcatttagtaacactttagattgaggattattgttttatgttaaaatataaataccttctgggtattaactcttttcagttatagcctttatggtaaaggagttgccaagggctcagaatttgataaggcaaatggaggagaaagcatgagggcttagtgggtgggagtggtggagagtgatatggagcgagacagaaactgaaaactgaggccagaggagaagaaactgtgcctatttattcagtttttcctgggagtttccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccagacatcgaatgcaatattctcaactaacattcttcttagaatgatgcttggttccctggagactttatgatcatgagtgctaaatgtgtgaggggtgtgtgtagggaggcagaaacagtgatggtttcatagatgtccaagttgctgctacctttgtaaaatcattatttgtcccttcatctctagcctgttaggtaccaatgtatttattgcccactcgaactacttcctctcatcatgggggcctcctgtttttgaggcaacataggaaattaggactgatgacgctgcatcagaaaagcttttgttttcacttggtttaagtctgatagagaagttggctacatagaacctccacaggcagttgctccaatgacttaaaatgaatttgtccttctgcctcaactctccacagttagcatgtgctcattcacccactcctttttatggcccttggattcacccaatccaaggtgaactacttccttacttctatgtcttcactgtcttacgatcttgatcaaacagacaacacactcaacgaaggtgtgggtgggaacggaacccacccacatgattgtgaatcacctagagactggcagcagaagaaaatcactgccaccctaagccttgagtggccagaggagagagacacattcattttcagaactagtgagagctacagctctggtaaggaacctcccaacaggagttgtggccatgggtaggacagctcaagaccataagctggcaaggaaagatcacagaggaaccagtatcctgatctttctctattcagctatttcttcccattggtggaagcccaagagaaacacaagaccagggtccctaaaggtcagcttctcaaggcacagagcagggcacagaaaggtggtgtgtcatactggaggggcaaaaaagctggcaccatctcactttctgcatgtataaaatgaagacgtaaactgccaggattgaatgtgatctacatacaatcatttagcacagcacctggacaataaaaaggaccctataaatgtagtttagtagtagcagtgatagtaatattagaacatttttactacattttagctatatcataagtaagtggctctccctgtagcctaataattaacatcccttatcatatcctaaaatttgtaagaaataggcttaagtgagacttgcttgtttagtgatattcatacctgtagatgtgaatgtatagctacatgcttctttaatttggacagagagaaatgtagagagttgtgatttcatgatttcaattctacagaattctatagattagatgtatagggcgttgctgccctaatggataccataacaaagaaataccccatcttttcctctctccatgactgagcatctgccttagtgcagattctggaaaggaggggatggaccatgaaatttaaattgcatatatagatgtggctatggaaatcatatagaaccaacattcctccctttcttccctctcctacatattgtatatgtaatacgtatgtgtgtgtgtgtgcttatccacagaatgtgtgagtttgaggaaaaaaacaagataaaacacattccgtaggtagtgcagtcacacatagctgaaaaacctgtatcagttatcaattatctatttgtttggagcaaattcctgcaaatcattaaatatacaaatttccactttcattgttaaattacccaaagtataatctcaaataacctctgacctcctggagttgatgacagttttatactgaaaatagaatttttttttgtacatctatagtgtatcttaaattacctaaaagaaagatgatgccagggtagttaaggagggaggtttcagttttggccaagtttcgtacatcttaattgcgatactttgcaccccatggatacctgtgagtgcaaaaatgtctgctttgtttggacttatatttatttttattgtcttcccacttttattttagattcaagggatacatgtacaggtttgttatctggctatattgtgtgatgccgaggtttggggtacaaatgatcttgccacccaggtactggtcatagttgtttgtagttttagaagaaaaaatgaatgagactcaatttaacactggtaatatcccttctttcccagggaaatttagtgagttgaaagttgcaagagtaatgctgttagtgttagtcacttttcaaaagtgttttgccatttaatattcatttttggggtcttctgtgtggtcatgtgggcctactatattatactttgaagagatcagtgaagtcatatggtttaaagtttcacttgatgaatgagcaaactggtgttcacaggggcaaagtgacttattcgaggtgataacactggtgagctggagaacaacctgctatcactttatttcccttttttttttttatcttggagacttttattgaaaggaactattcaaacttttcaaacttttaaggtccatatttctgagttctgagtgttctaatttgattattcataaaaaatatgcacagttcctattctcatggagcggatagttgatttatgaatatatgtgtatgtatcctgttaacgagtcatcatgactaaattaacttagttaagctacttaacttttcagagccttaagtttcttataggcccagcaagttttattggaaaaaaatgggcttcgaaggcagagagatgtggtgttttctgtttactagctgtataagtaactcatagaggaataatagcctcctcatggggttgtttagagggtaaaatgaggtaacctacatagaatacctggtttatgcattcctattgtatctgtaagttggagatgacactgtgcaacctatttaccacatggcattgtgattaccatggagacaatggttggaaaagggcactgtgaacagtgaagtgctgctgtcacatcacttattgagggattttttttgtttgcttagttatttcaacgtaagctttctattgagggacaacatgcacacagaaaactacacacaagagtgtacaactctatgaattttcacaaagtgaacatacttgtgtaaccagaacctagataataaaagagaacctcctagaaagccccaaggtacccttttcccatcactacctcatctcaaagataattatcctaacttctaactccatagattaatttctcccattttggaactcttaaccaatggaattatacagaatgttctcttccctttctggcttctttgactcctattatgtttgagaggttgatccattttttttctgtgtagttgtggttcattcattctcatggctctagagcaggggttcccaaaccccggtacggtctgtggcttgttaggaatcaggccccacagcaggaggtgagtggtgggcaagcgagctaagcttcatctgtatttacagtcactccccatcactcacattaccacctgagctctgcctcctgtcagatcagtggcggcattagattctcataggagcgcgaaaccctattgtgaactgtgcgtgtgagggatctaggttacgtgttccttataagaatctaatgactgatgatctgtcactgtctcctatcacccccagatgggactgtgtagttgcaggaaaacagctcagagtttccactgattcttcattatggtgagttgtataattatttcattatatattacaatgtaataataataaaaataaagggcacaataaatgtaatgtgcttaaatcatcccaaaaccatctccaccccctggtccatggaaaaattgtcttccacaaaaccagtccctggtgccacaaatgttggcaactgctactctagagtgtcctattgtaccccacaatttatgtatctattcttcagttgatgggcttgtgggttgtttctaatttttggcttttatgaatagtgctgccatgaacattcttacatgtgtcctttgagaacatatgtatgcatttttgttgtatatatatcttgaaatcaaatttctgggtggtaggatgggtatacaaaggtttgattttaataaatagtgacaaataattttccaaagtgtttgtaccaatttacatgactacaaatataatattttttaacatctgtaaaattgttacattcatagtgggatatacaaaaatacagcttgaatcattgaaaactgggtttatgtttttctcttttgttgacattctattttagttatgttcttagattgcatggaatacagcctcatttccagtaacttagcttgtggggaagaagggtgttattgtaaagattcttatgcatataaactcagaaaaagctaaacagtgaagctttaaaaaggccagaaaaatgtacaggtgccaggctgtgggatcttgagtgttctgctctttaggattgattctggtatcctgagggtctgtccatccttgtgggacctgtattctgcaggcaggtaccataaggtactgctgtaggccagcatcattctgagtgagcatctgttttgtttggttgctcttctaccatgcactttgttaaacatttggtcatcatcctgcttaagggaagcccatatttgcaatcatttgtcaggatttccagccctctatgtgaactatgttaccatttctaagcaattaacttctggaagctacctgctctcattggtccctaaggagtagatggatgtactgtccgcccttctagatttagaggttgttagatactctgtatttatactagatgctaaatgaactacacagaatcataagaaattcataagaaaactttagcaatcacaattttttaactaataatgtgagtttttaaataatagacataattcttaatgtaaacttctactaagactactttacaattttttttaatatcttaaaaaacaaggggcacttcttgccattttgtgctaacttagtctttattggttgaactagtgctaggcaaggaaggaattagctatagggagcagggaagacagatctaaacagttctgcacttatgagcatattagtgaataatagagatgctccttatggaacccaggcatgaaaaccatccttggacctgtcacatcttggaattatgtgctggactcttgtattggttcgttgactttagttgtagtttaggaagtgatagccagaaacttgaactcttgcttctagcttttagaccttctacttaagacagaagaactatgtatttcacctcgtctaacttctagtatttcagataatttcttctcagatacttttttttggctcaacctatgcttaatatttttagctaatgctcactctgtcatcattaaagtggtttgcagaagaatatatggcctacgcagaagaatatatggtctatgcaaataacttctcactgtacattctctatacagacctatacaaatattttcataaaacttctgagctggaggtggaactattacaaagtgttgtggttgaaaaaggttgatggattgaggttattcctcaagacctctttccaccacaaaactgaatatcctaattagagaatccattagaaggaacttgaccaagtctgtggcttaatttatgcctcaaagtgaagtgattaatattattcaatgcatgcataggaccagaaattcttatttgaataagttattcaacttatagggtaattaaaaactgaaagtaaactgtcatttcactgctatattcctatatattaaattaaactttaaacattatttaaggattcaatgtaatatatttagcttttttttttaaaagcaagtctggaagctgggccaatttctacaaatgttctgctcagtagctagccttttgtggaaactcaatagatcttaaacacttggttcatttaaattactcttctttttgctttcaggaaagattgagaagagttacagggaagtttagtggattagtcattcagttccttgatggatcacttgcatgtgccaatgccagggaacatttaactgattaaaacattctgaatgaatttgtcatttgggggtactctttgaatgaatatctttattgcattgactgtgtcctactgatatgacttaggcttacttccaacattaattctaaagaggctctggctaacttatctgtagaatgtgtgtccaagtcaagttcgtgatgtatttggttaaaaaaaactttgtggctcttgaaagaaatacaaagatttagtagtcagtattgtttataaagtctagggtggtcatatttaaataataaatctaagaattagatgagtactgttacacatttttgttaataaatcttaaatactggaaagaatagacttaagaaaaatattccaacattgaaaacctaagtatctaaacatatttcagtctcatatgccaaaaaatatgaaattatagcatttttggtcaggataaacgcctcctgcatctttttgtataagaagtattttgaatgaaaatagacttgccatgtcagactatttgaaatttaagttctgttttcaattttaggttcttaaaaaggtccaacttagccaatgaacataaaagtgcttactgctaatttagctgctgctgcagaacatgaaaggaaatcatgaggccattaacacatctagaaatagtcattttctagctttcggttcctaagatagcttagtgaaaataaaatattcagacaaggcagggtagggaggtgagtttttaaaggattttctttttaaactttccttccttccaccctcgctccctcacttccaccctcctttatttctccttctttatgtgtgttaacttagaacttcacttcaagattttccgagtgctaagtgataggggcagtgagatatacgctttatctccctgcataggcaatgagtaaaaaagatgtgaaattatggcaaattcaccagcagatttcaaaggtgaaaatgcccttcttgtaccagggttaatatgatctccagccatccattcacagatcatgctcactctgttgatggcaaaggaaagttctctttgaggccttgaaatggaaactgcacatcgtgcctggaaagtccctccaggctagtgttcaagaagtctttctttcacacttcagtttcttcattgcattatatttactgactgcctaccctatgttagaccctgtgttaggtcctgcagtcctgttcacaaggatattatagtcttgaggggaaggcagacattcattaaagactcacctcagtgttgacgggcagactgcaataaaaaagtatgcggcactgtgaatgtgtaacaggtgtgggcggtggtcagggaaggctgagactggttaactgggcagaggcaaagggttgcaggcaactcgcctgaggtggagaggcaaggctggtgacaggggcagggaggccgtggacagccgatatcacaaaaggcggtgctgaaagatgcaaggggactgaggacttctttttagctgagcaaacagtgcacatttcttccactcagacttttccttttctaattaaaaaaatggggacatccacatcttgataacacagttaatgtgtgaatataataactgcttaataaatccttgttgaaataggaatgctgattaaggcacttaggccagcagctgaaggaggcttaatatattcagagatgattcctaggtatctagaaaaggatattttaagctaagagaaaagagggacagttcaccagtttcttcccttctagggaaacaacataaaaggactggagttgttaaaagacagggtgagaagtctgttgacataaaacatgagaaaatgaagtttgtgatgttttgatgcagaagtaagttatcattattgttgagtgataatggcattaattttctgaagatgggcagctcctttcatcccatttaatgtgtatgtgtgtgggcatgtgtgcttgcatacctaaggctaaattaatttttggtacaatagggtagggttgctagatttggtaaatggaaatacaaggcatcaagataaatttgaatttcaggtaaaggaagtataacttttggagtatatatatatgtcccaaatgccctaccagagtggaattttcctcttaagaactctggaggcgtgttgcctcatttcccccatgtttttagtcattgcatgtataatgtttatatttatgtttattcgcagtttatttttgccacatatatttttagaatctaaattttcccaatagtctggaacctttggtgggtgtacataatgtgatgaaggattctcttcctggagaggctgctgatatatagccaagattctgtctttgtgctctgggcttctgtctctgtagtgttaatatttcaagaatgagactagagcatttttcttactttagtgccctttggagcaacagaaagctgcctttgctgcaaaggaccctgtggaatgattgttgatctgccttctagaaactgagctgtgcccaaaaccttttaccagtttctaaaggcacctgctttcattttcctaggaaggttctttaggtgagcgatagtcacccctatatctctgcaataccaagtgagcagcttgttgtgtgtagataccatgaaatagaaacagattcatgaagataagattagaaggtaatctttagattacagaaacagattcatgaaaataaggattagaagttgtgaatgaaaacaactgttgctttggatggctggatttaaaaatgttcctcaatattgatgatgtggtattttaattaaaaaataggatcagatcatgacacatagaagaagctataatatgcacaatgatctgcttttccaggaaatgagtatctttggggatcagcattgagctcactacacatgataaaaaataaaactcattggaaatctagaaattggcaactaaaaattgagtcaaaatgtgttttaaccaccccacccccctcttgtttgtttttattcacttctgataacctactggctgtttagttatattttatggttgttttggctatcacaaactcatacagaatagctggaattatcagtctcaacagggaccatgaagacatatgtgtgtaattcagtacatatattaaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttacagggagagggaaataaatatgccacccaaacctaggctaatacattcattgaaagcgagtactaataattatttctaagcctcccagcagccaaggcaaaaagggactccagtaacataacatgatcattatttcattgtttacttttactactccctattccacgttgagattgttagagatatgttagtgatcacctcaagtcttattacctccagaaatgtaaagtttgacttaaaatcacaatgaactcttccaatttttttcatactatattgcatgtgcttaagtaattctttgggcttggttttagatttttaaaaattatggtaaaaagcacataacattaaatttaccatctcaaccatttttaagtgtagggttcagtagtgttaaatatactcacattgttgtgcagcagattgctacaactttttcgtcttgttacactgaaactctctactcatgaaacaactccccatttctccttctcctcagaccctggaaattaccattctactttctgtttctatgaatttgaccactttagatacttcatatgaatggaatcatacagtgtttgtcattttgtgactatttcacttaacgtaatgtcctcgagtttcattcttattgtagcatgtgacaagattttcttttttttttttaaggctgcataatatcccattgtatatatttacattttccttacttattcatctgttgatggacatttggactgcttctatctcttggctattgagaataatgccacaaggaatgggtgtccaagtatctcttcaagatccttttctgaattcttttggatatatacccacaaatgggattgttggatcatatagtaattctattttgaatttttggaggaacctccatgctattttctgtaatggctgcatcattttacattcccaccaataatacacaagggttccatcttctctacatcttcaccaatgcttggtattttacgctcttttgatggtgaccatcctgatgagtatgaggtgatatttcattgtggtttttatttgcactcttctaatgattagtaatgttatcatcttttcaagtgcttatgggccatttgtatatcttctttggagaaatgtcagtttaagttctttgcctattttagaatcaatttttttgttgttgttaaagtttcttatatattttggatattaaccccttttcagatatattatttgcaattattttctcccattttataggttgcaatttcactctgttgattgtttcctttgacatgaaaaagtttttgtgtcattccatttgtttatttttgatttcgttgtctgtgcttttggtgtcatatttaagaaatcattgctaaattcaaagtcctgaggctttacccctatgtttctttctaggagtttaacagttttaagtctaatttttaggtctttaattcattttgagttaatttttatgtatggtacaaggcaagggcccaaattcactctttttgcatttgaatatcctatttttccaacactacttgttgaagaggctgtcttttctctgttgtgtggtcttggcactcttgctgaaaatcatttggtcatatatgcagtggtttatttctgggctctctattttactccgttggtttatgtatcttactttaggccataccacactgtcttaattactgtttctttgcagtaggttttgaaatcaagaagtgtgatgcctctgactttgttctttttcaagattgttttggctcttttgggccccttaagatcctgtagaattttataattatttttctgtttatgcaaaaagtgtcattggaatttttatagagtttgcattgtatctgtaggttgctttgggtattatggacaactttacaatattaagtctttcaacccatgagcatgggatgtctttccatttacttgtatcttctttgatttctttttgcaatgttttgtagttctcagtgtataagtcttttatctcctgggttaagttttttcctaagtatttaatccttcttgaggctattgttaacagaattattttcttaattttctttccagattggtcttgttaatgtatagaaaatgcaactgatttttgatcatcgattttgaatcctgcaaacttttctaaattcatttattagttctaacatttttgtgtgtgtgacttaaaagaccatgtcatttgtgagcagagacaatttaggttcttcttttccaaattttaggctttttatttctttttcttgtctaattgctctggtaagaacttgtagcaatgtatcgaatagtcgtggcaagagtgggcatctttgccttgttcctgatcttagagtaaaagcttttagtcttttctcatcgaatatgatgttagctgtgggcatttcatatatggcttttattatgttgaggtagtttccttctattcctagtttgttgagtgtatttatcatgaaagcatgttgaattttatcaaatgtcttttctgcattgattgagatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttctttgttagtctagctaaggatttgtcaattttgttgtttttttgggaaaaccatcccttggagtcactgattgtttctattctttatttgatttatctctactctaatttttatggtttcctttgctctgctaactttgaatttagtttgtttttctttttctagttactgaaggtataaatttaggttgttgattttagatcttttttcttttttaatgtagatgtttactgctatgcacttcccttttactactgctttcactgcattccataagttttgtatgttgtgtttttcttttcacttgtctccagatattttctaaattatcttgtgatttcttcttagactcattagttgtttatgagtgcattgtttaatttccacatattactggattttcctattttctttctgctattgatttttagttttattttattttgattggagaaggtattttatatgatttcaatcttcttaaatttgttaagatttattttgtggcctaacatgtggtctattttgggaatgttccatgtgcgcttgagaataatgtgtgttctgctgttgttggatgttgtatatatatatctgtagacccagttggtctgttgtgttgttcaggtcctcttgtttccttattgatcttctctctgattctgttgataactgagagtggggtattgaagtcttctactattatcatattggtgtctatttctctctccaggtctgtcaattttgcttcatttatttaggtgctgtaatgttaagtacatatctgtttttttactgttatatcttcctggtgaattgacccttttatcattatacagtattcttcgttgtctcttgtgacaatttttgtcctaatgtctactttgtttgatacaactctggtcacttctcctctctgtaggttcctgtttacatagaatatctttttttaacccttttactgtagcctatgtgtgtctgtaaggcaggttcactgattaccaatcagtaattctaatttctatcaattgtatgagacagaacactcaaacaagttaagtgaagcaactttataggcacagttaggcagcaagggacaacaaaagcctaggattcatagttccccaaagctcagagtgaatggaatctttctgtgtgttacctactttgcagtgcaggtgaagaactttgaaagcagtctactctggattgtatacccaggggcaatggggattgctgggctaaagtgctgcagggcatcctattcttggagggacaggaacagagcccaagctgtttcagatactttctccttatctcaagatgctgcactcctaatatatcctacagttatttttgagaactacaattgagaaagtggggaagagtgcagtcagtcaaggccatcttggaattcgttctgcactgtctctagtgctaaattgagtctcttatagacacaacatatggttggatcttatttttttaagtccttcggccaatatgtgtcttttaattggtgcatttaagctatttacatttaaggtaattactgatagggaaggacttactattgctattttattgttttcttattgtttttgtccctcatttcttctcttgttgtcttcgtgtttcatttttttttgtagtgacatgttttgattctcctctcattttcctttgtgtgtagctgtgtgtatatgtgtatatataaaaatttatatatattacatatatataaaccttaacgagtttgagtaagaagcagttcatgaattgggaaacaccaaactgaaagaggtttagtgttctgatgacaaagcataccttacatatattctatagatagtttatttgtggttatcattgcaatgagataaaacatcttaaaattatgacactgtattttaaactgataacaacttaactacaatcatgtagaaaaccttttacatctctgccccctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgactttccctaggaaaatctgagaaagcgtatcataggtggtctgaatttaaggcaaatatgggtggcgattagaccaattatagacaaacatataagaaagctgtgagaatgtgtgtgagatgaataattatgaaacaccaatgaaccagtgcagctggggatttaaacatctaagtgggcttaatgtatcattttatatagctgaagtaaattaaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttagataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaatagtcagtttcctcatctgtaaagtgagcacaatggtaggaccacaatttaattgattctgattggaattaaatgtactactctgtgtataaagaagtaattagtccagtgcctggcacatgataagctctcaataggtattagaccttttttttcttgttaattttgttgtttatgttatctttattataaccatgtgggaagttttatgctgaaaaatatataatactgaatttttttaaatagataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatagtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacgcaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctgcttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggcggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaatagctgaattgatcaagtgaaagaaaggatatcagagattgaagatcaacttaatgaaataaagcatgaagacaagattagagaaagaaagaatgaaaaggaaggaacaaagcctccaagaaatatgggactatgtgaaaagaccaaacctacatttgattggtgtatctgaaagtgacaaggagaatagaaccaagttggaaaatactcttcaggatattatccaggagaacttccccaactgagcaagacaggccaacattccaattcaggaaatacagaaaacaccacaaagatactccttgagaagagcaaccccaagacacataatcgtcagatttaccaaggttgaaatgaagggaaaaatgttaagggcagccagagagaaaaatcgagttacccacaaagggaagcccatcaaactaacagcatatctctctgcagaaaccctgcaagccagaagagagtggggaccaatattcaacattcttaaagaaaagaattttcaacccagaatttcatatccagccaaactaagctttataagtgaaggagaaataaagtcctttgcagataatcaaatgctgagggattttgtcaccaccaggcctgacttacaagagctcctgaaggaagcactaaatatgggaaggaaaaaccagtacaagtcactgcaaaagcaaaccaaaatataaagaccattgacagtatgaagaaactacatcaactaatcggaaaataaccagctagcattataatgacaggatcaagttcacacataacaatattaaccttaaatgtaaatgggctaaatgccccaattaaaagacacagactggcaaattggataaagactcaagacctattggtgtgctgtattcaggagacccatctcatgtgcaaagacacacatggctcaaaataaagggatggaggaatatttaccaagcaaatggaaagaaaaaaaaaagaaaaaaaaagcagggattgcaatcctagactctggtaaaacagactttataccaacaaagatcaaaaaagaaaaagaagggcattacataatggtaaagggatcaatgcaacaagaggagctaactagcctaaatatatatgcacccaatacaggagcacccagattcataaagcaagttcttagaggcctacaaagagacttagcctcccacacagtactagtgggagactttaacatccacctgccaatattcaactgatcaacgaggcagaaaattagcaagaatattcaggactggaactcagctctagaccaagcagacctaatagacatctacagaactcaccaccccaaatcaacagaatatacattcttctcagcaccacatagcacttattttaaaatggaccacataattggaagtaaaacacttctcagaaaatgcaaaagaatggaaatcataacaaacagtctctcagaccacagtgcaatcaaattagaattcaggattcagaaactcactcaaaaccaaactactacatggaaactgaacaacctgttcctgaatgactactgggtaaataacgaaattaaggcagaaataaataagttctttgaaaccaatgagaacaaagacacaatgtaccagagtctctgggacacagctaaagcagtgtttagagggaaatttacagcacaagtgcccacaggagaaagcaggaaagatctaaaatcagcaccctaacatcacaattcaaagaactagagaagtaagagcaaacaaattcaaaagctagcagaagacaagaaataactaagatcagagcagaactgaaggagatagagacacaaaaaacgcttcaaaaaaatcaatgaatccaggagctgtttttgttttgaaaagattaacaaaatggatagccagagtaataaagaagaaaagagaaaagaatcaaatagacacaataaaaaatgataaaggggagatcaccactggtcccacagaaatacaaactaccatcggagaatactataaacacctctatgcaaataaactagaaattctagaagaaatggataaattcctggacacacacaccctcccaagactaaaccaggaagaagtcaaatccctgaatagaccaataacaagttctaaaattgaggcagtaattaatagcctaccaaccaaaaaaaagaccaggaccagacagattcacagccgaattctatcagaggtacaaagacaagctggtgtcattccttctgaaactattcaaaacaatagaaaaagacggactccttcctaactcattttatgaggccagcatcgtcctgatatgaaaacctgacaaaaaaagaaaacttcaggccaatgttcctgatgatcatcaatgtgaaaatcctcaataaaatactggcaaactgaatccagcagcacatcaaaaagcttatccaccatgatcaagttggcttcatccctgggatgcaaggctgggtcaacatacacaaatcaattaacgtaatccatcacataaacagagccaatgacaaaaaccacatgattatctcaatagatgcagaaacgcccttcaataaaattcaacaccccttcatgctaaaaacactcaataaactaggtatttgtggaacatatctcaatataataagagctatttatgacaaacccactgatatcatactgaatgggcaatatcatactgaatgggcaaatgctggatgcattccctttgaaaaccgacacaagacaaggatgccctctctcaccactcctattcaacatagtattggaagttctggccagggcaattaagcaagagaaagaaataaggggtgttcaaataggaagagaggaagtcaaattatctgtttgcagatgacatgattgtatatttagaaaactccatcgtctcagtccaaaactccttaagctgataagtgacttcagcaaagtctcaggatacaaaatcaatatgcaaaaatcacaagcattcctacacaccaataacagacaaacagagggacaaatcatgagcaaactcccattcacaattgctacaaagagaataaaatacctaggaatacaacttacaagggatgcgaaggacctcttcaaggagaactacaaaccactgctcaaggaaataagagagaacacaaacaaatagaaaaactttccatgttcatggataggaagaatcgatatagtgaaaatgatcatactgcccaaagtaatttatagattcaatgctatttctgtcaagcttccattgaatgtctttacataattagaaaaaactactttaaatttcatatggaaccaaaaaggagccggtatagccaagacaattctaagcaaaaagaacaaagctggaggcatcatgctacctgacttcaaactatactgcaaggctacagtaatcaaaatagcatggtgctggtaccaaaacagaaatatagaccaatggaacagaacagagacctcagaaataacaccacacatctacaaccatctgatctttgacaaacctgacaaaaacaagcaatggggaaaggattccctagttaatgagtggtgttgggaaaactggctagccatatgcagaaaactgaaactggacctcttccttacaccttatacaaaaattaactcaagagggattaaagatttaaatgtaaaacctagaaccataaaaaccctagaagaaaacctaggcaataccattcaggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttattcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcattctactataaagacacatgcacacatatgtttatggcagtactgctcacaatagcaaagacttggaactaacccaaatgcccatcaatgttagattggataaagaaaatgtggcacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatatatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgcctgtgatccctgctactccagaggctaaggcaagagaatcgcatgaacccaggaggcagaggttgcactgagccaagatcgtgctattgcagtccagctttggcaacaagagcgaaatctatctcaaaaaaaaaaaaacaattactacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataatattttattcattaggttgcacactgatagacataggggttgtcatatcatgctttaaataaatatttcccaagtggctgatcaggtaatctgaatgtctgtccattggtggttatatgtctcttggagactaatacctaacagaaatcaattttttgtgtgagttgaatgtaaaatgatatttatatcattttataaactaaaaaaatgtttagttttggcacaaccttgaggaaagcagtgtgacaagcctggtgccagatcccatggagaactaaccctggacagcctgggaaaactcctatgtaaacatggagaacccagatcaaagagtgtttggagagtgataacaatcacttaggacttaccttttctgaaaatcttaaaaattttaagattgtgaatttttaaaatagtgattcataaactatttaggtgacttgctgtggagccattggaccagagattttgttcaaaatgaaaacaacatgcagttaatcatatttgcaatggggccattgttgtctctttataggtttagttttaaggctggcattaaagagttttgcaaaattatttatttatttttctaattcctgggcactgcatctgccaccctgaaagaggccttcaggtaggtggtggtgtatgcattggtctcatgaactcatgcaatatttgccatagttttctcttgggaacaaagtgtgttattgggaacaaagagttccataatcaaataaatttgaaaagaactaagtttatttattgcaagatttcttagagcttttagtaactaatatgcatataacttctcaagatagggatgtaaaatgctggttttcacagacattttcctttatggagtctatttttcatggagcatgttttgggaaagttagatttaatggttaagtttcttataattgtgaatgacttagtgagttaattggagggagagagagaattaattgaacagagtagttgttatcatttctatgttacaggagaggaaactgaggcttcagtgttagtgacttgcctatcatggattgaagacagatttctagattgtaaattgttaacatcatcatatttaaagacttaaaggaagaaaaagtatggaaagggtttagtaattctcttaaaaatatccaatttatataaggaactcaattaactagaaagaaaacaaataacttgattaaaaattgggcaaaggacctgaatagacctttctcaaaagaatacatacaaatggctggcaggccattttaaacagggtatatgaaaaaacgctcaacattactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattacgcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgctgttcaaagggcacaaaatttagttaggaggaaaacgttcaagagacccattgtacaacatattgactatagttaataaaaacgtattgtatacttgaaaatctccaatagaatagattttaagtatgcttatgacaaaaaatgataaatatatgaggtaatgcaaatattagttggctcaattcagccatttcacaatatgtttgtattttgaaacatcatgttgtacaccataaatatatacaatttttgtcacttgaaaaaatcctagaaaggggaaaaaagaatattagtagaaaactgatataattcaaataatatctgtggtttacttaatagtgctatacttatgttaatatcctagtttttgataactttagtatggttatgtaaagtgtaaacattagggaaagctggggaaagggtaatttggaactttgaatctttttcttttcttttcttttttctttttggagagatggggatcttgttctgtcacccaggctggagtacagtggtgcaaatcatagctcactgcagcttcaaactcctgagctcaagtgattctcccagctcagcctcctgagtagctggaactacagttatgcactaccatgcttggttaattttttatttgttcatttattgtagagatggggtcttgccatgttgcccagtctggtcttgaatccctggccttaagcaatcctcccatctcagcctcccaaagtgttgggatttcaggcatgagctgccatgtgcggccaggaactttgaatcatttttacagcttttctgtaaatcaaagactttctcaaaataaaaagttaaaagtaaaaatttataccaacatatatgaaatgaattaaataaaaatgcacatattacatcaattgttattatgtaatgcaaaaaatttcctagtcttattaggatttttttttaagactaaaacattttctaggccattcagcaggagtgggattgggcttgccactggccttcccccttgctacggatgtgggcttatggatatatgtaaatactgtacatcagatggtgatgcctttgctcagagtccctgcaatcagaaccctgataggaggatttatcctgctttcaacttagcagagagaaagaattacttttactcttcagacagtttatcttttcagtcgttccttttctctgacatttttccccttgactagagtaaaagtagttatccttaatgtgacattggaagagagagatcacggtcatattttttgtacacaaaccgtctctacatcacatcacattgaccttctcctattcggggagaagggtatttattgcctgctttctcaccaagttctctagcttttgatgtttaaagttgttatttcatgacatttcatgaacttattttctatgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgatcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcagtagagacggggtttcaccatgttgcctaggctgatcttgaatgcctgacctcaaatgatccacctgcctcagcctcccaaagtgctggaattacagatgtgaactacagtgccaggcctttctttctttttttaaattttaagttcagtcaggggtatatgtgcaggtttgttacacaggtaaaaccaagtcatgggggtttgctgcacagctgtcatcacccaggtattaagcctactacacagtagttatttttcctgactttttccctcctcccacccttcaccctccaccctccagtaggtcacagtatatgttgttcccctatatgtgtccatgagttgtcatcatttagctcccacttataagtgagaacatatggtgtttgattttctgttcctgtgtttgtttgctaaagataatggcctccatctctgtctttcttgcttgcttttgttgagcagggggtgggtaacactgcccggtgattgtgtcacctcacactgtcaccccaaaatttcagattccagaataactaataaataaaagtttttccacagttggggaaaggaagataaaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtttacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgctttactaatataatgttaaataaatatttcctggccaggcatagtgatttacacctgtaatcccagtgctttgtgaggtggagacaggaggatcacctgagcataggagctcaacaccagtctgggcaacatagtgagaccttgtctctacaaaaaaaaaaaaaaaaatagccaatagctgggtgcaaatacttgtagtcctagctacctgagaggcgtgaggattgcttgaacccaagagtttgaggctatagtgagctatgatcacaacactgcactctagcctgggcaacagagcaagaggccccgtgtctttatatatatataatatataatgttttctaacttttgtggttacataattatagaaatattagcaaaattaaaggaaggggtgagattttatatttatcaattgtatggattgaccgttcagtattggttgattgattgagacagggtctccttctgccacccatgctggaatgcagtggtgtgatcagagctcactgcagccttgacctcctgggctcaagcaattctctcatcttagcttccccagtgctgaggttacaggtatgagccaccgtgaatggccagtgcttttttttttttttttttttaatctctcttcttacacatcacttttgtttttatattattgttattcatatatatgtcttgtcacccccctattgagttggatgctctttgaatgttttttatttcatgggttctcaataaatatttgtgccacaaatgacttaatattacttgttactatgaaatttgtgcctctatatatgttgggtgacaattagaaaactaatgataattattgcatcaaaaataatttgagagcacaaatcttatagcattgtcatgtaagatgggtacatatagatttttgttattcttcatttgttgggcatgtagaataaatccacaataaattcaatagaagtaaagcttatttctgcatgtatatctagataaacataaaatattgattctctgttttggaaaaaaggaaaagataatgactaaaatttctttgtggtctctatgatggtttaatcacatgtctctcaaaaatctaattttctaagaatcaatctgtctgtgtgctagcagactgtgaaaacctactggtttctttaaacatcaaaagaagtcagcctttaaatatttggacgttttcctctgagatacggctgcactaggcaaacacactgacattaacatttctaaagcaggctcaaaataaatgagaataataaaaaaaaaactccttccaatacctaattgccattttaattaaagcttctgtttgtcatcagtgacaagagattgcctcagaaagataaaataagactgtgtgtctttggctttcatgaagacaaaaggtttgtgcaagaagtcaaatacccagataactttgctgttactttttaaattaaacaatttgctaagcatcaggtgaaccaaattattcataaattaacattttttttaggccagtacatctcaaatctagtttatggatggatttcctggtttgggtgcttaatctagtgtgtgctagaatcttatatcacaggctgttttatagagataaaggaatctggaaatggaaatcactttcttaaatggcttttgatttgaaattttatttattcaggttaccttaaggttataagatcaaataagaacatactacaaagagctttgtaaaagataaaatattacttgttatcttaattattattatctggaaaacaaagttaaatgcatgtgtttattccacccctccctctgacccaattaatgcatcaggaaattgggaatttgctttggtgcatctgtttaaatgctaagaactgggacttggatttgctgctcaagaatccctagcccagcttcctaaactttataaagtcaaataaaaatagggtcaccaggtaacatggaaagagcaggcttatctttcctctcagcttctgaatgaagttgaaaatgtgttttattgtagaacaggtaaaatgtgattcttataaatgggaacaaaagaataattttaatgatgaatttgaacctggaatctgaacaacagataaaatgcaatcagagaagcactgagactatgcagtgcatttgacacagaaaataccaagagcagcattagcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagttcccacctatgagtgagaacatgcgatgtttggttttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaaaaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgttgtttttcatgaccttgacatttttgaagtgtacaggccagttattttgggttaatctgatgttgtttaatgattagattcagattatatgtttttggcaagaacaccactgaaagaatgttgtgtcctttttcatgtctcgtcatggtatctatttctgcccttacttgtgttcacttaattaatgtggtatctgccatatttctgcactgtaaaattactctttgtcccctgtaattaataactatcttgtgggagacacaccaagactatgaaaataaatatatctattagtgttaatgacggtcagttttctcattgttgaagaagaaaggaattatagatatgaaaaggtagaatgctagagtgaacccatgtgctgttggattaagattagcaataactgtatgaattcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagaggcaaggagaatcccttgaacccagtaggtagaggttgcagtgagccaagattgtgccactgtactccagcctgggcaacagagccagactctgtctcaaaaataaaaaatgtatgtagtatgattgattgaaaatcatcatttgttaactaccatagtaatggttgtttgaggcaagaatcatcaatgaattctcttttttaataacatagatttgttctttctgactcctccctatccattcagtgcacagcttttagcacacaattgccttggtcaaatctgttcttaagctgggcttccccttcccattgtaccatgtgtgtgaatatctaagaccacaaaatatgctgcttttccactactgaagtaatatcttacctcatctctgtttagattcttcacacattccaaggaaacacttagctaattttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtccatttctaaattcttcatattaataagccactagttttaccaattaaaatccattgctagcatacattatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttattcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaactgaaagttttggaaagactctagaaaagaattgctgaaagtgttattaaataaggtgagggtaagacaactatgaaagatttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagaagacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttcagtgttattttgtagtaaaagttcttaaaatattgtgtaataaataatatttgatttctatctatgttctcttaggcttggtcccatggcagcctataattcaaggttaaggttatgttgttatttaagaatttttagcatctgtacttgtatgtgctgcataaacaaaacagttattctattgcagaccagtttttccttttgaaatgtagaatacaacaatcacttctcaggtttaattaagactgtgtttgtacagaggtctgtagtttataaaagcagttaagcaaagaaatgcttttgttatatacaaacagaacaaaaagggaaaatactgtcttgatcctttcattaaaggtcaaaaaaaaaaaaaaaagaaaaaaagagttcactcaattttttatctcgtgttttttcacaaataccagaaacagagctgtaagatagtaatttgttaaactacacattaagctggtatttgaatatgaaaaggtatttccaccccgtgcaatattgcttttttgaaatactaaaagcccttacattagggtggtaattgaatgactgcttaaaaacaaaccctgtctgcttcattttgacaggttctttatacatttttgtggagggtaaacatgtcaggatgtagcagactaaggaaggagctggtattgaacagggttcatagtcaaagtgacatagtttctcattctcaagaagagtagttggcatggttgttttgggacctgcaatatagtttttctagattcaacatggaaaacattattctaaactctagtgatctatctgcccatagcttatgccaagcagcatggattatacatttttgatacctgtagacgttttaggagccttcttgatgttatgttgaaatcttattcctgtagttatccacataattttctaccaaatcaccctgtagaactgatgcataattacttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagtgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagtagggcaataaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatagatgaaacaatacatttacccaaatatgtgaaccaaaggactatgtgaatagagagggactgattgtgtctactcagtaaataggccaaagaaagggcaacaagcgaatcacaaggactgtttaaagccctggccaatggggggttgggggaattgtgtcttttgcataagttgctcccagtttgaaatcttcttagtacactcccaaagctgctctgtggctgccagcagtgttagcctgagatctcttaatcctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggatacgaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagggcagctctgtgatcgtgttctggcttcaagctgaagtctgctgatggcatttctggaaatgtttttgttctttgataaaatgttggcacctccttttcctctcctccttgccttgaatgaagatgcaaggtctgtaaatatacagcaaccttgctgttatgaggaaaaggcaaagagttattgtttctgatactgctgaactgctaaacccacaccaacagctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtcttaagtgaagaagttctgggcaagacttgtggccaggggaataggaaggaaggcagacatctcagagaagaagcaaaagtattcagtgcagattcagtgaaggatagaagaagccagataacctcaaagtttctaatcaggaagataagtgggcctgcattacagctttggggataggcagataatggtaaagacgagttctgtcttaaggtatgttgagtttgagattatgatgatggaacatccaagtggaaatattacgtgcatagtcagaaatacaacatttgatttgaggcgaatctatacaatgcctatgaccttgggcatggagaaacagaaaagcaataaatgatgccaccagttatttgagaggaagaaaagaggtcatttgcataaacagacagagaaaggagataatacggggttggtacagggatgaatatgtcatcatcagtatccaatgatctagagagatcaagaaaggtgaggaatgaggagagaatttggtaaatctgacaaaaagtgaatctggtaaaaataggacaccaatgatttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatattcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggttcatagggagttgtgaaggtgagagaatctagaacaatgctcctggagagggaggagaaatctagtgttctcaggaagaggttaaagtccaagtgcagattgtccagagaacaggtttggttgggggaggtggcagagaaggggatggtggcttgagcagagtaagtccaaatctcagacagagcttgaaatggtgagatccaaaaattgcttctgagtacctggacacagcagcttgttacaagtagagatttaattcttgttcttttttttttttttttttaaatgagaggctaatttgtcacacatttcttttactttctctgtgtatttgtacctttctttccacttaagtgttggtcctttccacaaagttctttcctcccagttttcactctttttaaaactatcttttactaagtctaccacccttgcaaaattacacaacatattttcagtatattctagtgcattatttacttataaataaaattgaggccaagtataaataaggtacaaatgtactgagttttatctcactttggtgagacttcttaaatacgaaataaaaagccatccatgttccaattctggcaatatattccccttccacacattcaactaccctcttgctgaactcaaccttgggtttctacagtgttactgaaacctgccatccattcacagtggcttctcctagtgatttccatggagcacaattttttaaatgtccttaaaaaagcatgctactttaattatatggcagatggtgtgttgcatggtttcctaactggtgttacttccacactgtacttgaactatataaagaactttgctctcaactcaggaggaatcctgcgaagctcaagtttgtattaacttagagaggaacaatttctgtaggttgggacaaattttaatgtatatgttatagtactaattttattatgtaaaaactacacataaaccaaaaccataggggtttcaaataatcattgcaaattatgattaatttagtaagactttaaactgttgttttcttctgatttttaaaagtgagtcattatcatgtagaaattttgaaaaatggagaaaaatagaaagaaaataaaaattgctcttaatctcaacttcctggagatagtcactcttcacctatttttgggtgaggggaggggcactttattttttaaactgaatcatattaaacaacctttgtttcctacctcaataggtcaattgacttttaattctggtttcattttctgaaaactctgtaaggtcagcaagcaaaggtgttagaagtaggtagcatataacataggaattagcagatagcttatttctgtgggaaatagaaaggctgactaatctgtgacatccagtaactttttactgagaaaaatgtggttgcaatgagtaaagtctcccatgtcactattctgtagaagataaacaatgttttagctttattatgatttataccgtattcttttcaggattaactctaagcgtagaacattttagttttataccttgattagaatcatttatttatatcccaaaacatagaaattaatttggggtgataagtccttttgttgtcaagttatttttctcttaacatttgtatatagttttttgtattatgtttcctaatggaactcacatgtccattagagtcaactgattattcaagacagatttgctttaatctcccagtgtttattcagtttcatttaatattgtacttttatgagggttatgaatcataggaatgtagataatatgaaacatattgcattattttagatggaaagttagactttgtaatttagataggttgtcctcattttattacatagggcattttcactattatcttaactgtggaaatatttgatgagtcagttcatcttgttttatagaatttccaaattgacatgaaaagaaataattgttttgcattaatttatatttaatataagcacttgagaggtaaccaggaatgggaggaaaggaggaagacattcatggatatgcattctagagtaatgaatttcaactgccggaaatcaatggctctgccagattcatatgttaatttttaatgagtagacatttacttagaaattgatttatttggactcagatgaaaagcaaaaatggctgaaaattgtcaataatagcatacaattgcctctttaggtttagctgtgattatttttgaaataaaatcctcagggatgttggaagtgagccctaacagggtacacatgtaccattttatttgacagagatcttcattgcatatatcctaccacttttcatttcaatgtaacgagcaatcaaaaactgcttgttgagtttgaataaaaagggtgactggtggggggtggtagtatttgtcccttttgatgttttcatagtttaagtttgaggttggcaaactatagcctgcaggcctagtccagtttgccatctgtttttgtaaataaagttttactggaacacagacataatcatttgtttatgtattgtttatagctgctttcatgctacagtggcaaaattaagtaattgcaagaggagctatctagactgcgaagcctaaaatattagtatctagctctttactgaaaaaaaatttcaactaagtttagttaaacttttcccttatagtactgtatttcttaaacctgatggtatactattgtttaacatgtcaatatggaatcaaattaccaagatgctaaaggagaaagaaacctggccgaataggaacagctccagtctacagctcccagcgtgagcgacgcagaagacgggtgatttctgctttgaaaaatttttcagataagacataaataagtaaaacagagaaagatatatcactttataatcgagggctaaattgtatgatagtatcaaaaaacccttttcaggctcagtggctcatacctgtaatcccagcagtttgggaggcccaggcaggtggatcacttgagctcaggagctcgagaccagcctgggcaacgtggtaaaatcctgtctctacaaaaagtacaaaaaattagcccggtatggtggtgtgtgcctgtagccccagctacttgggaggctgaggtgagagaatcatctgagcttggaaagtcaaggcagcagtgagctgtgattgagcccctgcactccagcctgggcaacagagtgagaccttttctttaaaaaacaaaatcaaaacaaaaaaccaaaaccttcatatattctgtatcataaatatatgtgaattgaaagtcactttaatgtggtcagagtcagagttctaaagttctcaaaattgcaatgttagcatactaatgtagtaggatatgttttgatgttttcgtctagaaatgggaacatcaacttagtgccatatagttatatggttgtatctaggttagccagggttctaaaggaatctagagcttttctagaaattgtggggtcagaaaggatgatgtactaggcttgcttgagtatgaaccaggagagatgcatgtgtgtgtatgtgtgtgtgtgtgtgtgtgtgtgtgtgttttgttttgagagggagtctcacactgtcgccaggctggagttcagtggcacgatctcggctcactgcaacctctgccacctaggttcaagtgaatctcccgcctcagcctcccaagtagctgggactacaggtgcacgccaccaggcccagctagcttttatatttttattagagatggggtttcatcacgttggctgggatgatctcaatctcttgatcttgtgacccgcccaccttggcctttcaaagtgctaggaatataggcatgagccaccacgcccagccaaaagatgcagtaatttcaggtagttctatgatcagtatatagggatgccaccacaactgtttctgaagaacacaattttaataggacctaggtagggaggcttaggattaaaacatgttgaaaatctgtcttcagggactaaatgaagctggaataaataacatggcacacagttgaacatatattggggaaaagggtgatcttggaaggggcactagaagcaattataaattggtgtgaacttatatgtgaacataaataacacaagatgatacattggtaacttgtatcatttacatttggttttgtatcttgagtgtcttgcataataataaagcagatcccagctttaaagagtggagtgtttctgctctatattgaaataactatcagagggcagggaggttaaaatcagaagtaggtacgctccttgcataactcttccatgcgagtggtggcagattaagaaccttctgtagtagaaccattttgttacacattgccaaccacaaaatttcatagagtcaaaaaataaaaataaaaaaagaggtcaatgtggtggcctggactaactgggaaaagctttatggagaatattggattttctctcagtttctgttctgagtaaagtatgaagctgcctttataaagaagcaagttggtgactctgggatttgaatgagtttcccagtcctgttggggtactataataaaatacgttaggctgggtaaattatagtcaacacagaaatttattgctttacagttctagatgatgggaagttcaagatcaaggcaccagcaggtttggtgtctggtaagggcctgtttctcatcaatgataccttttatgtgttctcacatggcccaaaggggcaaacaagctctcttagacccttttataagggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccaggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgtagtaagaaaggtgaggggagataagggtgggagagtgatggaacataagggaactaaggtaccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtaggatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcaggtgcctataggtctagaaatccccagctcattagaagtgctgtaaatcatagcatccttcatgtctcttgagtgaaacttggcacctccagcttacaactgtgtggtggtcacactgtccctgacttcaataatgttaacagatgacaacttccattgaacgatgaaactgggtgagccagtgccagtaatgatggattgggtggctgaaagtttctgcagagaggacagcaagaggatgccaaggaagctggtctgtgtgtaactaaaagactagtaaatatgagaattgatgggcacatctatcacccatggggccactgtgtcctgaaagaccttgtatgaaagctttgagaaaggctttggcaaggataaatgccccagcgcttagacaagtatgggtctctgcaggccggactggttgaagagggcaacgaggtgaggtttcgtgagttggaagttggcctcctgtagtgtgcagtctgacacagaaaaggttctagctcacagttgcctggttggagcatggaaacagctccagcttaatattcaggacatctgtctgccgaggcctgttttttttctgtacgttttcatggctgtttgtagacagtggtaggtgagattggaagaaataagagacttgaggaaaacagagttaaacaagaaagtaaaagtaactcttcaatacccagtacatggttaatatgtagatacttgaggatcctttatccctcttatgtctcaggagatggggtgctggggttgtggggagggcaggggaggagtaagggaaaaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagtttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaacgacaacgtaaagaatgaaaattgtgctaagtgagttctgtctctttcaagttcaaattggtaggttttcctggcttgaacacaaaatgaagtcaaattgaagggtcagagatacaagaaaattataaggagaacaaactcattagaaagggaactgaaaaatggataacaagaggaacaaatacagggattttccatatctagggaaaaacaatccataggttctatggggactttaaaaatatagaggattgagaaaaaaactttgtattttgcaacaattttaggttaatagaacattcgtaaagatagcaaaaatagttcctatatactctatatccagcttcccctaatgctaacatattacagttttagatttttaatggttatgataaacatgagtctatgatttatagatgtcactacttttttatagtattagaagaaaattagacatataattttctacttgaaaatttatattcttgtttacactttaagaatatgtaatatcttccaaccacattcatatcaagaagaacaaaaacaagcaaacaaaacccctgatcatatcttaaaaaaacagcccttctctgagttatttacatttttagcaggatgcaaaactttatgcccaaattttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgtccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcaccatgttggccaggatggtctcaatctcttgacctcatcgtgatcctcctgcctcggcctcccaaagtgctgggattataggcatgagccatggcgcccagcccaaatctcactattttttagattaaaatggaactgttgtggggtataatgtaaaatttatgcatttttaaaaagcaagagatagcttaaaatgggactctttggtggtctctggcagtgtgcagactttggtggtatgagttcactctgttttgtctttatagctatagaggttgaaaaaaaaaaaaaccattaccttacactaattgacataaattttggaagcattatttcagcaccaaccaatacaggtttcccatagtccttattggatatcatagaatttttgataaatatttgtgaaatgaagcaatgagtaaaaataaggaatgtcattttgaaatgtggggccttttctgtgtctcctcaaatcccacctgggaagtgctcactcattccaggtaagacaggctttgctgattctgggccttggactggcagggaagaagggactgactaggttaagtatctcctcaaggtgctggaggcctctaaataaaatgaggtacctcccccttcattcctagcctggaagaagactggagcctcgagattacagttatagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcattggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagttgttagcctccgggttgcctctttattctcttttggcttcttagctcttttagcagtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccaatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaatacataggtataataatgtgattcaagtccaatattcacacatttacacataggtgtaaaagtataattcaagtccaatatttattgattttttgtttagatgatctgaacagaaaatcaataagtgttggacttaaattacattttcaaccaaatggacctaacagacatatgcagaatactccatccaacagcagcagaatacaccttcttctcaagtacacatgaaacagtctctaggattgatcacatcttaggcgacaagacaagtcttaacaaaattcagagaggacagcagtgtgtggcccagaagggaatgccccctggtggcttgctaagcctggaacacatctaacaccattgactccagccccatctctgtaacttttttgggagtagaataggaacccattctttgccagttgggcagcagctctttaccaagggaccaagatgagcaggctgttccttttgtcagtgcaacatttgcaagaggagtgctgtgggaggagataaaaattgacttccaaatggccagcaaaatttcagagacatttttgggactggcttttaggttcagacttaataagtaaaacagcagatacttaagattttgatttccctgtgggttaagatagttcatagtggggatggccaacattgctacagcaagctggaatccacttcctcaatgtactggggcattatggaaaataatgatctctgagggagagaaatgattccacatctttgggaacaatatctagatatattaagaaatgacctcagatgaaaaacaaatataaaaacattttggcaaatcagaaggtgcacattatatggcattcatgatgttttatatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaaataatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattattatagacaacaaccatttcaataacatttctctgtcttcatgttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccagatttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagcagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatactaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtctatgctcttttctatcatactaccaccaaaaaagtatgatgcatggaactccaagtgctttacaaggaatttcctctgtcagtcacagctaggcgtggcgagaaatagtgctactcttattaactagacctgattttgaaagacttgaatatttccaagggaagatacacttagagaagtatagtttcctaaaactgcagatgtctatgtgttagacttagaagattattccaaaatcgtgttctgaaaatgcatttagcttgttgcagagttgttcatagtaatgtaaaattggaaaaaaatagaaatatccatcaaagagggattcaacaaataaatactatgtgacttaaaacttacctattttgaatgatgcctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaaatatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttcaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctctagctgagttcatataattactaccccctgaacacttagcagtcctgccatttgctccttctggataagcaggttccctattctggctactctcctgtattcttgtgtgactttatccatcagagaccaactcaagcttttggggcatagccaacgctcccctccaaatgtgtatacctatgaaaagggacaacatgacctgacaaaattctctttctgatttgtgagttgatacatatgaaaagtcttagagcatataaaaagaaatcaaatatttaaatttgatgtatctcattattaaaaaatatatgaagaatcaggatgttattatctggaaacatctgtttggtttctgtatagtaccagtaaagttgatttttatattgtatgttttacatactttgaggtagaaaattatctttaggttaactatgcctgacagacatcatctcttttacttaggcaaggcatttcatttgtggaggaagaagtactttgcttgacagagaagaagagaccgcgaggagcctggtgtagttggaagaaagtagttttggcactgagggacgagaaagctgagagaggatgggagagtgggttcagccaagctagccccctgcctcctctacccaggacacacacactcagaattttaagtacaatcatggagtttaattatgtgtggatttctcaggaaattgggaaaggttctgaattctctgttttgcaagcagggaaacctttgagaatagaggtagcccaggcaaacagagtaggaaagagatggcattttttgttgcaggaattccgtcgatgcacggggacagaggggctttgcgctgtcttgggctgtggaattggagacaggccatgtttaaactgatctctaaaggtgtcaggttggcagggcagcgcaaggttatctggctgcatgaggttatctgactgcacatactgttatgggcctgggatgtcccctccctgtgtacaaatgcaggagccacaggtgctgctgacagctcacaagcttctgataccctactgaattcgagtcctttgaaaaagaccactagttggctcttctcacttctttttcattaaaaatgaagaaatcagaaacgaccattcacttaaaatgtggagaaacaaaacctttgatagtctgtccattcatttcctgccatcttcaccgctgaaaagtgtactaactttaagtgactacggtaatgggcagtggaacccaattcaaaattcagcagaaaatttatgatctaattttgatagagatatgtgaattatcagtgagttgaagttgtctctgtgttaagtcattacagatgttaaatttagcaaagacatataaactcctgggtgtggagagtgctgaatgttgtagtgttaaacacaaatgtactgcttgttgaattggtctcagatgaattttcctgctgagctgacacagtacctctggccgagttggaacatttcagtcctacagttcaccatcgtgctgtcaatttgtccatgaagatagtttatgggaatgcattgacacacatgtacatgctgttggaatcttgatggatttctttctttccttcctttccactgccccaaacttttctatagaactttttgattagcatagttcaaatttatgttttgaaaataattaggttcaattaatcagagctttctacctttatatcactgtttgtttaaagaaataatgttgattttttttgttataaaatagtggtagatgtcatcccttgaggtgacttgaaaaatgccaccttcctttaaagtaccattaagtaaaatgaacataaggaatgttaatcggattgtctcaggatcaatgcactgatattgatgtgttaaatattgtggttattagctgaaagtatttattaaccctaataagccagcaactctatggaactttctatttaacttttctcataagctactttgggggtaaacaaatcccaattggaagtaaggactgcaaatcaacccagccaagtgtaatgattagcaatggaaatatcccattgtggaattctagttccatatgctcgtgaaaaaaagattacagataattataattaggaactcagtgtgtgggagtgaaagtaatgattactgaaagccactgatcatggtgggagtaggggtgtgttataaagatgtgaacattttatctaaaacgtgcactctgttaattagtaactttcaatacatttatatcttaccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtcattattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctgcaaatgtattataagggtcaataggtacgttgattcttactttttcctccatacacattacacaatactgagaagaaatgtattccatcctgtctagcacggcagtggttggactttaataaatgacggctcccttcctcttcatctgagtacattgaactgctacaattcattagtcagaaatttgaattgtttaggacatggtaagattctggagcctaattccaggaaataaagtgaaattcaaaggaagccccagactgctccaaatctgcccttcaaattatttgtctcatttacacgttatttttttgaaatggcaaagattatcctttctgataaattttgtgcattaaaagacaagttttatctattctaggggagctccaaatttatacaagacaattgtgataaattttttcttaaaggaagaaatcctttattatgcaaataaagcttctttattaacttctgtatatttgaatggaggttggacttttctcagttacctacaatttatacgtaactcaattatatatacttctctagaactgcttatgtaaaataatatttcttaacacatttaaagtggtgactccctattatattgcaatacccttcctctttttttctgaactaacaatggaattaaaattcaagtgctgaaaaaacacggtttcagtatccttatattcttaacatggagccatcatataattaaatgcaatgtctagtttttttcataagtgtatgaagttgaatattctgatttggtgcagtgttttcaaattttcctgaccataagaatcacttgggggtgagcctagggtatcatttgttaaaaaaaataaattcctggcctcccccctttaacctactgaatcagatgtgtagaacctgggaatatactaagtcaatgagctatctcaggtgattcttataatcaggtaagtttgggaccaatgatgtaatgcagtaaaacttaagggtgtatcagaatcacccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatccttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatgatagcattgattaatttgaatgctttgtctgaatcattactgttgagattctgaaagttcagatactgaaaagaggaaaataatgttgacatggagaaaccaatcatgtgagagctgtttttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtactccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaatttaagtaaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcattttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggatacaaagttagatgtaaaacatgtttttaatttgccttttgccagtttaggtgttgataagacactgagggatttttatattatgccatttttacatttaagttgaatatctctttaagcttgagacaaggaaaaagtgttatgaacaattttatttctaaatagcttgttcacttttattatataatattagtaatcgtgtcaaattcctaattataccaaatatcaagggttacaaattattattactgaaaatttcaaggaatataatttatttagtggaaatcctgagattaccaataccactattttccctctcctttgttagcttttctcctaaccaagctcaaaatgttctgcactttcaaaggtcactgctaagtactcttctctttttattctgccttctttccttaagttatctcattcagccccatgattttgaaaaccactaataacctgacagttcctaaatcccaaatttttaccttgaactcagggtttatcttaggatctagttccttatttacaattgtattcttaatactctagagccacttacaaatctgttccttctatagacttctctgtttctacaagcagctcctccagcctctcagttgcccaaaccagagatctggggatccctctctccctctccccattgctcccaacccagttcatcagtagctcctcaaataaatccacttttctcttgttctcaccttagttcagtatactgggaactctcttgcaatcaccaagtggttactccattaatttgtatctccaaatccattctctagcagctagatatattttttcttttgaaaatgtaagaactttcacttctttgccttaaaacctccatagaataaattccagatttataaaaaatggcttttacagccccctgccacagcttcatttcatttcctccctcctctcctatgcatttgctgtaggggcctgtgttagtggagtctcctcaggatcttcccgtgctgtttcttctgcatggaatatttttcccacactatttgcctggcaatttgcctagcttgtgttagttcctcaggggatgcgtagtaccccactccagtctaaattagttcccctctacctaaaatactccatattttctttcagagcagttcttatcattttaaattacatgtttgtgtgattatcctttaatatatctttctcctacaggtgccattacagtatatgcactatatatccagctcagtgcttgacactaaattgggactccataaatatatgttgaagaacttcaaatattccaaaatatgaagaattttccataccatgtcctcttttttgtggccctctttttttttttttttttagagacggagttttgctcttgtcacccaggctggagagaaatggctcaatctcggctcactgcaacctcccctcccggattcaagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcagtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaaggtgagatgctcttaccctccttattttgattttcatttttgaacacaaagtggttttacttggaggttcttaaagtaataatgaacacagtcattctcatagataagactagctgtcactttctctcaattcatgcaagtgttattaagaaaccacctagggatgataatatgaaattaagtgtagtgaattcattatggattgcctttctcattttttacaaggtttcctgatagcaaagctaataaagtataaatatgttgaggtgtcaagtattttttttaaagagattaattagagctcagtccctaagctatttgtaaattactatactttttcattgtaaagtgtttagtggaaatgctgttttaataaaatgattatagattataaatggtttcattaagtactttatttccctgtcactataccagttctacagaaataaatgactttaacgttctttttgctgataatttaaatgagatctaaaagatgaaacattattttgaaacaaatttaatttaattgaccctgcatggcttggaatctttgctgcccatgatccttttatgattaaatactaaagaagaaagtgtaatgtgaatatttttcttttatttctacatcatgggattcacacttcctgaggtgaaatatcttattcttttcagataatattagtagatgtattagaaatttatcctctcaggggttgtgctggtcagtttcatcaacaaatggaattcaagatcccttagtaaaacgaatgaacttatgtaacaaccacaccctacacacaattcaaatgtgtgttaaatatctttgtgttcagacaaattgatagcctagagatcagtatgtgctagcttatagtcctgcaaacaagtgtgatgtttattccatttaaaaattgccactgaggcgggcttacgcctataatcccagcactttgggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggctcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattgagcagatttagttttttgaaaaaatatattgacaactatatttttcctgagagtgtaaaaatgattcagaaaatatctgctattttaagtaacattttgagtgtaatattgcattcattagttgaatgtcctgagatttcacatgttaaatgtagagttaagtacaattagtagaagagtattttaagtggcagagatgggcagaaattattttgtggagtgagattagttgagttcagataaggaccctctattaaagaagaaataaaggaatgtggattagaagacaatgaaagactttttggtgaactaatgtatactttctgaagatttgggagtgtgttgcggggcggaatgcaaaggcaaatttgtagttacatatctagacatgaaaatagagggataggccaagttcacctgatggagagcttttaaggctacattctatatttgatgattgtggttgaaattttataattattaatagtatgtatgctctgaaaggtaaaagaccttgtaacctatatgtaattcttactgagcccaatactttgggatatacttaaatcctaattcaatatagcagatttgaatcttattatcagtggagtgcatttaattgaaatcaaattgatttaaacatctagtaaggaattctcaagtttaaccttcttttccacctctgggtacattcatatgcttacatctactctcaaaccttagaggtagaaaaaatttgatttaagagaagatacacattttcattcaaattgattgtttaaatatttataagactaattttccagatacattataaaactgaattgtgctttggacattcttttcaccacagctaactaatattattagttctaaaatgtaagatactaaaataatttccaaatcagaggtctgacatgatatttaagggctatttttacatattgtattagaagtgcattgaccattctcaagaataataaatatttcaaatattgtatttaactaaaataacaccagtgtaattattttaataaaaataatttcaaaagagcccttgaactcctgggctctttgaaattttaaccgttctacttatgactcaaaaaagcttaaaaaagatggatgtcattaatctctacaaagtgtatctattgttctgataattcatgaggtaattataggactaatgctttctaattgtctttaatgtgcaaatatctttaatatgttttctcatagtatatgctaatatatgttaattttaaataatttgagcaatacagagaaagaaaattccataattttgctccctttttctagagataaccactatcaccaattggaatatattcttccagacttgtcataggtaaatggtaagctctcaagctctcatattatactataagtactcttctgttatctgctttttaagtatgcacacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtatttccttcagatttctttaaattcctaaaaattaaattgctggatcaaagtagatgcatctttaatgttttaaaatatattattacattaccttccagaaaagttgtacaagtttatattcaatgtactgttgtacaaaaatttccatttccctacctttagtaatctgataggtaaaaatagtcattttatttgtctatacctttgtaaacatatatatatacataatgtataattatttgggcatctttttatatattctctaaacagttatataattttgtgaatttgtcttttccaaaatttgtttgtgaacaatttttataaattaagaaacacatagcaaatatttccagtttcaattttttaaaaaatatcaatacagttttaagtttctatatggtcaaatctatcaatcttttcctctatgctttctggtcttaatatatttgttaagaaaaggtcttcttcacccaaaactatacaaatatactcttatagtttttcctagcatttctgtgttttatttaatctttaatctatttaaaattattttttgtctgacatgaagcagaaatctagcttttttgttcaaatgaatactcaattcgttaacactaataattgaataatgtattgtttcctttgttatttaaaatgcctcttacaactgcatccattgaaactatcccattgggcttttcattacaatttgattgtatttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttgaagaatatatttctttaatacattgccatatcttacttattttcataaaaagatctataattcacttctctggaattttatcagattgtggtctatgttttacaaagtactttagcatgctttatttccttttttccttgacacagccctatgaatcaggctaggaattatatttttttgacaaataaaaattatagacatagaaatttgctttgcaaaaagtcatgcaagtaggtggtaatggtgagtaaaatttattaatctctaatccaatactttggtttggagagaaggaatttaattagttcagtaatttctatcagtacgatatttatggactttgagttttattatctcaaataaaaactatgcttatgtagttttcttttacatttttctaagttgagagaatgaatttgtttccattttgaccatggaggcttcactgggtatgaatgggggtgagggagagttcaccctaaaggagtccctgagctgagaatattcattctctgatatctgccatctgttccttgaacatgagcagatgctgatgttcagttaatcagaggtaatgcaataaggattaaagtgttagatagttctaacccattccggaagttatgggtaaaacttaaaacctttaatcagattcatcttgacgttgaaaccaagttggctatttgagccaaaggttctgtatctctatgatagctagtcccaaaggacatattctattattgtcattaagagaaaacatattaaggatgtgtttgcacacagcattgggtcaagataattgacattgtattttatatgtggttcagagatctgtcttatggaaaactcagagattgctttaaggggtttgttgcaaaagaaagattcaattaggcagtttaaaataatttaaatgtcagttttacaatacagacttaatacaaatgcaagaaggagtccatttgttgatatatacaccaatttattaaatggtagaatagacttctccaaatctagagaaagatcagtttagactattaatgtattatttcttaagtttgaatagaattaggttttttaaaaattgaaattgaaatttagtctccttgtcccaagtgacatacatttataaaatgtttttaaaaagtaaattcactgtttttaaatcttctacagaatattttttgtaatgaaaaacctacatgtatatattactgtacagtacaatagaactgatttcatttctaagaaataccactagtcgttatatattttatgtcattgagttgaatttgtaagtgatgcatataacctggagttttgtccttaccaaatattgcatagaaaaccataaattcctggaaattgactatttttcaaactatctcattaatgaaaatttatgctctgaagaaaggctaattatgtctcttatttccacttaagctggtataactgtaaatgattttcttatttttataaatcacatctgttctaaaacttagctccaataacactctatgataataaatggcaaaactcacataatattgaagcacattgggtatttccttttcagttttaaatatgcttaattcaaatttagatgattaaagaatatatttggactccaaagtgactaaaatcaatgaaaataatatattggtgtgtcatagttgggggtaaatattaccattaaaaactgaaaagtcgagaatggtgtgaacctgggaggcggagcttgcagtgagccgagatcgagccactgcactccagcctgagcgacagagcgagactccgtctcaaaaacaaacaacaaacaaacaaaaaaacccctgaaaagtcgcaaggaaggaaaaacgattctgtgaactcactacataggacacaaagagaggtgggaaattttgtcaggaatgttcgtgacatgaactctatttaataatgtcttattcccgttgatattttaatttttcagataaagtattttaagtaaatgtgcaacattaattagaataaaatataaaagtatgcgtctatttgaaggcctacctaattacatataattttctgatgaatgccctaattaagcatcaagttatatgtttatacctgtgaaataattggagcattacatttaatctttataacaatacattgaaagagaagtattagccatgtaggtattaaaggtatacatttagctagacttcatcattgactttccttttaaagggacatgacatcctgttttccatcaagagaacatcgaattaatcctcacaccagaaacaacagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctttacatgaaagcagctgacactacaaaggacgtagtacttctgtttaataggcctcatcagccttttatgctcccttgtgggcttggctcatgaacatctttaatgttatttaaagctgtttttattgtttatttagaaacattctttatacattttgctctaattattaaatttgatgatctttgttcttatttactgatttaattagctacaaacattcatacattaaaatttattccggacaacattagtgttgggattaatgattttttaaagaacaaatcacttgtacaatgcatagcccagagtaggggctcagtcaatctttgtgtaaatggaagttgtatttgaaataatccattggatgtgtataataagaatcattcttgcagaaaaaccctaactggatggaaactatacagaagaagagcttgagataatcacttttatttagattgtcccttcttaatgagttctaatgagcaaatgattgcagtgaggtacagcacagtggaagcttcttctgtttacaaaaacaaatcaatggtactaactacccactctgaaatggactcttttttttttctcagcactctatcactagctttgcctgtagaacatcaattatttttgcttccaagtgaagagagtcatttcagagaagatgtgtaaaatttagagggtcactggctgcccatattttaattagtatcccatccccaccacagcgtatatatcagtgtgggtttcctaaaggagatggctttagtgcgttttattaaatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccactcacttctcactcaaaccaaaaacctagaagtcatcctttactcagtcaagaagttgttttacctcatgtttcttgatatttcccactcttcttcatcctttttattaggaacctacctaatcccttcatcctttttattaggaatcctttttattaggataccttcctaatctacctaataccttcatcctttttattaggaatctagctcaggccatcactatctctttattgtaatgctgaatgaaatagtcatctaatgtaccatcttcagttttgtccgtatcaaatccctttagcacatatgcagagtgatatatctaagataaaaatgaaaccttatcagtttcctccaaactctgtaatgtgctagactttgtcacagagtaggtacctattcttgtttgtcaaatgaataaatgaagaataagaccagaggcttctcagtatccaaggttggagttatctggattctagattgtatattgtctaccatcctttgagaatgtcatgtatcaaccaaatttttgtttctcagttttgcttggaacttcacaaaaccagaatgaatagcatatttttatagtgtataggttgtatatatgaacagatagggtctgtatggtgaaaatcaaacctatgtgcctatatgcttatcttttagtataatctattaaatttttattaataatttcttaagagaacttttcaaatataaatctttccctcccttacactatgtagctggagttcagtgttatgaaacaaagattccttctcatcacagtttgacaactggtgttttgatttctagtctttagagttgtgtaaatttgttctaacaaagaatcattttagaactgtttgcttaaaaaaaacttgccaaaacaccaaaaagtatatgtgatgatataattagatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgattttttttttaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatttggccattttccccttgtattttgaaatgatttctgagtttagaaatcagacattatagcataagattagatagaaattatctttatgatataaatgtaatagaaacagtgctcataggtaaatcaatcttgtgttgttttaacaaaaaagtatttgtctattgctttactagttcatgagactcttcttgattctgatgattgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacacaacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttccatctcccctcctcccaacctgtcagagccaatagcatggctactgaaagaacagcgtgattgctctctgaatccagacattgtcctttcctatgacagacctggagaaatatcagacaactgaaccttttccagcgtattttgaatgtacgtaatcttggctgtagtcatcagcagacaagataattattcgttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagaaagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctgagtcacagtctcatttaccatcagaattcacagttttcttctttattttaattagtagattaatcctgtctcagcaatgccattaggtgcctgccttgatggtgtggaaaaatacacacaaacatctgatatttctgagcatttgggttgtgacaaatttaaatgtgttctaatagatcatctgtgtataaatagcttaagatttatagatgttttttaacttaaggatgaggaaactgaccactataggataattaaaaacagcaactctttgtaaatgcaggagctaagttgtcaaatgccagggcaccaacaggcaatattctgtaatctaaattgggtaatttatatcattgtcacttgaagatctgatataaattggagtcactgaatcatcccaccaacatctcataactaaagcaaattttgtttccttttcatgggtagggttttagtcaattgaataataaattatcctgtcttttctgaatcataggataggcaagcttctgtaggcagaactgatgaaatgaggccccaaagaagatattttaccctgttttaaaatatttccaatgaaggatatggtccagactactttggttatacttttcaatatttgaaatagtaatcttatgtggttgtttgaaaaatattttcaatttatcaccgaagatttgtctgaaatgttcggaagtcaggaatgaattaacttctatataacacccaatatcctggtcagtacctactcatagtcctacagttactgggtgtaaaaggcaatgctcctcttcctttgaaaagcataacctttcaagcgcttacagtttataaagaacagtcacgcacattttctcttttcagtctcacaatgacactatgttatatgaaaagattattaattcctatcagaaattaagattgagagaggttaagtgactcactcaaggtgatatatttagggagtggaataattacaactcaagaacatggtggcacgttcctgtaatcccagctactcgggaggctgaggcaggagaatcgcttgaactcgggaggcggaggttgcattgcactgaaatcacgccactgcactccagcctgggcaacagagcgagattctgtcaaaaaaaaaaaagttatttttgctccaaggacaaggtactttgcactctacattttgctgactctttggcatgccctataaaattgggcatggtaaacatgcattacgactcttttggaaaatttgttcctggggcaatcacgtgaattgggatgtggttgggagcatcattaattgagtctgtggtcagaacagagactagtataaagaaatacccagtgtaagtggcatcagtcagatattcagtgtaaatgaattgggaatgatagacacagtgaacggtccaagactgaaatgaaatctatcatctcatgagtattcaggggactggaactatattttaggaaggacgataggtgagaaggcctagatacaatcaagaaggaaacagcctcaaaaaataataaacctgcttaagataccctcttctgaatggatggagtttgatgatctgttggccctgttggtcagggaagggtgaaatgggctgaggaaactggaattctgtaacactaagatccaaggacacttccagaaatggcatttacaaggtgcaagtgttccctgtaaatcttctggcaaagggctttgaaatttaacttatattggaagaaccttaaaaagttagtagagccattcatatttctgtttggtttaagctgtgcctgctaataacattgcactgaaatgcaggcgtgaattcctataatgttaaaatcaaattgtttacctcagtttgaaaatttgctcaaatgagagtgattggctattgttagctctcaatttgactttcaagacaccttgaaatagcttcaggaaaaaaacgtgatttctagttaagctgttcagttaagcactttgtgatacaaagtatgttaaggtaaaaccttttatttaaatcaactttaagaaaacctctttagaaagttgcagagtataaatgaggaaacctttaaaaaaatacagctttatttcttttacgtatctattgggaattgagctaggtagtcgaggcaccagcatgaggttcttaagaaatctgctttaatgaacaaatcagagtgatttgtacttaatacttgattttgtttcaaaggccacataggcatttgaaaaataagtttttgcctgaatcctgtaatttcagctttcttagcaatttctcttttctgaaacagtgaaaatgtaaactttagggtagcctctgttcaaataatcacaatatgtgaattgaagtttgaggagttcatagagtgttactgaatttgtctgttttctaaaggaaattgattcatttttttcaaattattttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcaggtaggagaaacactcacactctccttccctatccctgcttattcctacccgtataatgttttattaataatctgatttgcaaaaatttatcagaaagattgtttaagtctgggtgtggtgactcattcctgtaatcccagcactttgggaggctgaggcaggtggatcacttgaggccaggagttcgaggccagcttgggaaacatggtgaaaccctgtatttctaaaaaacatgaaagttagccagatgtggtggcgagcacgtgtagtcccagctacccaggaggctgacatgggaggattacttgagcctgggaggtcaatgatgcagtgtgctgtgattgtaccagtgcactccagtctgggcaacaacagaacaagaccctgtctcaaaataaaaagaaagaaagatgtgtaaacctgtgtaccattgaactaagttcagtattgtctgtgataaaacagatatattttatgtttctaactgtgaatgctatgttaagtttggactgaactaagatgtagcaaaatgctgtatattaaatatccttagtacaaaactgaatcaatatatggaaatgtgcatctgaaacaatgggaaccaagtagaatatacaatatatgtgtgtaatacataaaaaatttatacaaacatacacatactaattaccagtgtatatataacatatttgcatatatgatcatgaaagaatttgaagtgatataaaacaagcataatgtctattaggttactttttagttttaaattaggtataatgacaacaataataaattactccccacaagaacaagtaaaactaaacaaaaaaaattggcactcaaactggttgaaaaatatttaaccttgtcttagaaatgtggtttaattgaaagaacatgggttcttgatcaaatctatccctgtgcgatcttgaacaaattatttcaggtctctgatcatcaatattctccatataaggtaagaaaaatagttacacttatcgcaaaattattattagagtaaaattagggtatatggaaattgactagcctgaacatttagaaattcaatattaagttttctttccttcattaatgcttataatctgagacagtggtaaacttaaaaaaaattacttaatatacttattaggctagtgttattgagatgcaaacaataacagatattcaccgagtacctgcaatgtgcaaagtggatattattcaattcactttatttctttagctgatgtgtttataataatcctcaccaaaaatccctgttttcaagatagataataaatttgaaaatgttaatgcatttcctaagtattgcaagttaacagatagcaatgttagcctttaaatccaggactgccagtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccacggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtctttggggttaaggattatttggagtctaatcagaagaaaaatgaaggtgatcattgtcatgaaattcatgagacacctaataagttaggtactgttcactgtgggtgaaatgtaaaatagtcataatttctatttcaaatgaattttttgaaaagactgtaacatggacaaatgtagctctacatgaaatgtgctttcagtgtgtgtgtctgtcaggtgcctttctgatgaagtgacaaaggaatgccattgattagtcagatggagggtggtgagcagtagcatcctgctaccttgaggaaaaaagcccaagtgaaatgcactccagtgtacaacccctgccattctgttttcctgatcaccatgatacaaatcaaacatgacattcatgatcagccagtacttagttgtgtgactatcccagtggtctgctttgaaaagcactgcatagccttgtgtcccactctgctttgctttcatgggttgtttgtggtgattgctaaaaattgagcaagatgaagtatagttatgaattagccctctattatcttttaaaaatgaatgtacttttctgtaaacctgggagtgctggcggtgatgtgtcaggtggtcagaagtgtgattccatgttttcttcctcacagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctggtaggaaattgcgactccatatttttttacgtgtgtgtgtgtgtgaaatcacaaatagcagggactcctctgtggaactccaatgaataacacagggtgactacctttgaaacatggattggaggtagcatgcagagccggcccattcagcttctgctaagtctcagtggaaaactctgagaaaatgacttgaacctggagctgcacaggttataagtggaaaactctgctttagcaaggaatgaattattaaaaaaccctcaaaaatatgtacactcatcatctaaatgactttagagtgcaatataaccatttaattatatacctatgggaagtaaacatgtctcagtgctgccttatgatggttgagacaaaatttatatagaatctatatttttcagctaattcctagaatgtaccccttatcctcatggtccaaaatgggtgctgagctccagccataatatctgcattccaaccatcaggagtgatgaaaagatgtaagacatagcttcttcctttaaggacgtttctctggaatagaatagatcatgtttgcttttatttcatcagcctggagttgacatatagccacacttagttgcaaaggagaatggaaaatatcatttcaaggggctatatgctaaatgttgtctcttctgttactaggaaataaggggagaatggatattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttacgagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgtttttatataagagtgaattttattttcttatttatgcttttctgtattttttctatattcaccaaactctttataatgaacccaactaattttataattgcataaaataaaccttaaggaagaaaagatgaagattttgtcattaaaaaacaagtagaagaaagatattggagataaacattctacgaatgaaaaagaaaaatttccacagggcatgttctgcttatgaatgaccatacctgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattacaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgtctctactaaaaatacaaaaattagccgggcatggtggcacccgcctgtaatcccagctacttgggaggctgaggcaggagaatcgcttgaacctgggaggcggaggttgcagtgagccgagactgcgccatcgcactccagcctgggtgacagagcaagatgcaatctcaaataaaaaataaaataaaataaaataaaataaaataaaataaaataaaataaaataaaataaaataaaataaaataaaataaaaacatagatcaaatcaagtcactttcctgcttaaaatcctccaatgggttccattaaaataaaacggaaactcctgactgtggctttacaaggtcatttatgatttgcccctgcttgtctacctcacctgcctctccatccttgcccaatctcactacatctcccaacctcatccgcctctcacaacctcacccgtctctccagcctcactgcctctcccaacctcacctgcctctccagcctcccctgcctctttagttttacctgccgctcccaactgcacctgcatctccagcctcacctgcttctcccaacctcacctgcctctttagttttactgcctctcccaacctcacctgccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacagtaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagagggtgaggactctgtactttccatttactttttatgcaaacttgaaacttctcgtaaaaatacagtctaaccacccccccaacctaccacagactattaataaaaactgatttggatgaataagggaaaaaagcaaatccaagatttattgcctagtggtgtggttggtgtggggagaaggtattccaaaatgaacagcttgggttcaatttagacttaagttgcttaaatttttggatttcttgaaaatggtaatgaactgtgtagatgccatccaagaggaaaaattgttaccactaaaaaatgcagaatatgtttagaataaaaacaacctgaaatctttcctgaacagatacaaatgttttcttttttcagtatggaaagaaagaaatcaggcaacttggtagcctacatttgttgaaagcaaacttgagtgcatcaaattatactattatcaagggaaaataaaataaaatattctagaaaacactgaccctgagttcatctgcacagattttttcccctaaatttagctttccatatttattacccactataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatttaacatggagttgtaatagcaggggattacactggaaaacattttgtaattttagtagggcactatcaaaactagtttgtttgaattggtttgacttttttcattctgcaatcgtgtttttatgcatgtagacttagctccagccctaatgttttactctagtcacatttctacgttttattctgtgtaaccaaagatgaataagcagagacggaatcagcacagatagtcatgatagaacgaatgacagttctgtaactcaagagaaataggaaaatgtgtaggaacacatatatttgccacttgtaaaataacattttctcatttgatatgccattttgtatatgtctttaggcttttaattattcaactaaacaagaatattttggatgcctactatgtgcaaggcagtgtgcaaggtgctagagaaagaaatagtatgaagcaaaacttctgtccttgaggaatgggcaaccctgatgggaaaggaggacttacacctaaaaagggaagtagtcacacgcagtgttcagagagttgaccacatggtattttatgtccttagctggagtcttagatcatttagtcctatgatagacttttcacagtgacttataacacacttcttctaccacctctgccacctggtactcagcagaattttatttccaaatacatttgaaagaaaaatattatctgactttatatactttcttctttagatggccgagcttttccttttcagtgttctcacctttctaatttttcatgcagtcaagaagtattttcctaatatatttgatcatttccattattttaagttgttatgaaaaatatttgggtaatatcttaaatatatcattctgaagtggaatagctacaggaggttgcaactgtaagaaataagcccaaagcattctccaaggtgacttctgtgctaccttatttaacattaacataaaagttaaaactttactatggtaagaacaattttttttaaatttgttgttaaaaaaaggaaatcaaaacaatctagagaacataagtcaagggttatttaatcttttactaagtcagttgggggtgatttggagagcagttgatagtgctagagtgagcaggaatctagcaaaaaagagctaattgctgtctaatcacgcttgcaatggaatgaatacactagtaagtattacagttaagccaggcataatggttggcttaaatacattctgttatatcagtgttataaccagtatatattcagcctcaggatgggaaagagttgtagttatgtctatagttccccgatttagttttgcttattgaaatccatttaaattaaaattggattcagtcaaagatagtctcattccatcactgtctcttattgtgaagtttgtgtggaactctattagtttgcatttcaagaagtatctttgcttgtatagtaatagaacctaaaaaaagaactgtctgctggcatgtgcccaaacagagctcggtgtttaaaaacaagatgctgtattcttggggtatggaaacttccttcacatgtgggtacagcaatgtctttggacacattttctgtgtaaggggaaaattatcagcatcttgaggagtggcaaaatttctacttggtaccaggatctctaggaccatggatatcagagatacatatccataagcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcgtctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataagagtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgcttaatttgatgaatgttactttattgtttattaccaacttgcacttgcaataggaattctacactttaatatggtctgctcctcaagaatgcctagattctagtctaaattgtttcactagctagttgtgtggctttaagcaagctaagttttagctcagggttttcaactataaaatgtggttgtccatgatagactgtctttaagataacttctaagtagaaagattgtggttctaggaatttaggtctaattcaggataaaatgggaatctatgcaagatttttgagtcctaatatgacgaaagtgcatcttttcagtattattaaataattacattgactttgcaatgattctgggcaattagttaaacttcttactggtaagagctggaaggatagtttcttcacaaaagctggacaatttaatccatctttgagtaacagtatcactgcccccttcagtaaagttttctttttaaagacataattttactcttaaagggtaactttacacacccctgctctggatacatctaatgcataaagtaatgtcaacctttatctgggcaagtcctctattcttttagagacaaagccctgacaaggaaataagatccattaggagatattcatgtgacagaaccagagaaaagctctttgtattactacaacaggcaaaggcaactagcagctcaggctgagacatcagatatgtaaatcaggccactgccagattctatcgactgaatcaacccagccgtcatggctgagtcgtgctgacttcccggctcagggattatctgaggacatcttctcaccttctctgcttggcttttgcgctttgtattttatttccatcagtatcatttagagatcttggaaggaggtgaaactcaaatcgaccattttttctccctgacaacttagataaattacttagttgagaggaaaatttgaaatttttgacttaaattgtggtttggattattggtacattttagctattcatctcatttgttttttctatagctactaataattgaaagctgactgcagaaaatagaataaatttataattctcaatacaatagaagctgttgacagagagaaaaatcaaatccccttatgaaacaatttcatatgagcaatgattttatgttctgagaatattaatgataagatatgtgaggacacaatttgagacttttattactaaaagatttctggttatttctgaggaatctcaaacagaagcttgttttgaggtaaaattatactcgattatctctttatgacgtttattagacaatgggaaaaacagaaacaacttataccatggggttaacaaatatttacttgggggcttttgagaagaacttgaactataaggttttggagtatgttttgatcctaaatttattttacctcaaataagcatgtaataaagttttaacatttgttttactttctgatgtttgagtattatatttctacaggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctgggaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggaggaggaacaagtagggtgtgtttagagaagcgtgattcatccatgtcaactgagacttaggggaactggaacaccatagttctaggttagaaaaattttacttcattcagtaagcaagggagaaaatgacaaagccaggaattagtactgtagttttggatgatgattctggaagtggtacttaggaaggagtgagatcagaaggaccagaacctactggtagctgagtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttatttgacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacagtccaggaaaagattgtacagtgtcagaaagcaggtaattgtttttaatttttttttctgttttttttttctattttgtttggaaactataataattcttggtagatttttttttcagaaactttctgcttctcttaaaatgcagttattttatagcaatgcttaactatactttaagttacactttagtctttgtttagtacagatgaaatccaagtgataataggtgggttgtatgtgagcgtacagggttggggtggtgtctgaagaagtctagagggatgagggtttctgaatctagttttgtggtttggaaccccatcaaaaccttctactgctggtattgaagctatggttccatacagtcccttaaaacccacttcaattttacaattggaaccaaaatcctattaatcttccaggcttttgccccattactagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagattctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttccgagactcacatagctagtaagtggtagagctgggctccacactcatgttctttactatgtgctatgtttgtgatgttagcaccaggaaagttaacgtggtcttaggctgcattaataaaaatataaaaactagaacaaggagaatggtggtagatccctgacctcatgtaggcttctccaagcccattttgagtacagcgttcactcctggaggcaagttcccacagagctcagctccaggaaactgggcaatgcagtggccttgcctggatgccatctttaaagaagagtttcattggcaagctgaatatgtttgaatggttaactgagagaagacttgaagggattttacccaatatctttcttcaaatatctaaaagcttgcactgtagaaaagagtttagacctttttggtctgtgtccagctagcaccaaggagtagaagttccaaggaaggagatttttggcttgatgtcagtcatagctttctgaagatggaatgagctgttcataagagaatatgatttccatctttaaggtgctaagacaaaggctgaagaaatgtgatggtgatggttttcataatcttcaagctcgagcagatggttgagctaaaaatactttaaggtcattcccaaatctgaaatacttgggtgtttcccaaaatgctatttttaaaaaagcctttttatttttagccaacattactgattactcattgttatctatgtgggttccaggacctactattaagcgacagggatggttcataaagaaaaataagacatatgcattcctcacatatggttgccattgacacatcagaccatttcatgcataaaccaggaagaggacaaacaaggtccatgtaacctgttggaataatttgcttcttacttatttacttattaaaattttttttaatttttaatttttgtgggtacataggaggtgtatatatttttggggtacatgagatgttctgatacaagcatgtaatgtgtaacaattatatcatgaaaaatggggtatccatcccctcaagcatttctcttttgtgttacaaacaatccaattatactgttttagttacttttaaatgtacaattaacttattattgattatagtcatcttgttgtgttatcaattactaggtcttattcattcttcctatttttttgtacccatagaatttacttttttccttctcatgtcattttctatggctcctggctgttttaaatacaatttagcctaatgcattgactgttgtcaatttgtgcataaggacagctacttggtgggatgaacagaatgaaaaggataattcaatttagggatttggaaattatgagaagacaggaatgtgaaattatattttactgataatattttcattataagatgcccatttttctgagatatatactcagatttcttatgcattctttcttcaaagggatggagttccatgaagaacttcataatttgggggcaaaagaaggcttgaagggaagaaaactcaacaaagcaactgagagctttgcttggaacattacagtattgaaggtagatgaaacactcagatgtcccctgtgcctttacttttcttctcctcatctctccaatgtgtagagaaatgtaaaggattaaatatgatggtttggatttttaaaccttcactttagattcagggttacatgtgcaggtttgttatataggtaaactgtgtgtcgcggggggctggagtgcagattattttgtcacccaagtaataagcacctagtatgcaataggtagttttttgaccctctctctcctcccaccctccatcctcatgtagtccctggtgtctgctgttcctctctttgtgtccatgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgcctgctttctaatggggtgtttatttttttgcttgttaagttccttataaattctgaatgttagacctttgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctattgcttgttgttgttgactttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatgccactttttatattttcttacatgaaaaaagaaatgatttaggcagacaatatattcttgacagctaaatgggagaaaaatagctacaaacaaaattaataattgctgacatttaaagaacactcattttgtgctaggtactgttttatgaggtttatatgaattaacaatttaatactcacaccaactcagtatcgttattaatctcattttacaggtgagaaaacggaggcattggaagtctgtgtatatttcctgagggcgctcagctagtaaatggtgtaactaaattttaagctcaggcagtctggctccagaccctgtgtctttaacctgtgctgcagagatgctgcacatgtttatgtgaaagtgttaggttagctgtaagacatattacaaatgtctattaaaaattcagtccacaagtgataagcccctactatgcattgggctctgtgctaggcactgggaatacgtggagaacatgagatacagaccctgacctcatgaagttagcagtctgagtccagtggaggagggggatggataaggcatcatttgcttaaggagcagggatgacctagagctgtagtgttaaagaggtgcttattataaccctagattataatgtggcagtgtgtaccctgatataaacattttatgttcagaagattttatatgggcttgttaatgtgcctgtcacagaaaggtgctagggatacaaatatcaggaggattacctgggtctccaagactagtctataaggagagacagacatgtaactaataatggccatcaattgttcagcacttattttgtgatcagcactcaaggctaggtactttatgtacatttcccctttcttccttgccacaacagtgcaatcttgcaacatgacatgctgactctgataggactctctccatctcacaaatgaggaaattgaggcttgtgggggttgaaatttcttgcctggagtcacacagctagtaaacagccagcctgcaatttttaactcacgcccatggttctatccactacactgttctgcctcctctaaaactccatccatgtggctgagtccctgtattagtcttttctcacgctgctaataaagacgtacccgagagtgggtaattaatttataagagaaagaggtttaattgtctcacaattcagcatggctgggagggccacaggaaacttacagtcatggtgcaagaggaagcaaacatgtcctttttcatatggcagcagcaaggagaagtgctgagcaaaaggtggaaaagccctttataaaaccatcagatcttgtgagaactcactcactattatgaaaacagcatgaggataacctcccttatgatttgattacctcccaccaggtccctcctacaacacgtggggattgtgggaacaacaattcaagatgacatttgggtccaaaccatatcagtcccattgggtccaggcagcctagtgcaggaataagaatgcaggccctgtgtgattacctgatagtggtgagactagccaagttatataatctccctcagggtagtaataatacctacatctcagattttgtgagaattaaatgagataatacatacaaaagatgtaagtcacagtgcacaaaactagacagcatatatgttagctgttatttgtttgtttgccaggtgaggataaacatggagaaatgaggtttttgttatttttatttctttgttaacttctgacttaagcccacttagtgttgtcagagatttcttaatgtttttgtttggtttagtaacagaagctgattgttagatgtgattgagcaaatgctgttcaaattattccaagagagagcttttcagacagaattgattttctattattataactcacatactagctgctggtatttcagcttgagcactagagtagtggactactactaaacaagagtagagaacatttccacacttccaatagctcctttttctcctccattgagtttggggcctgttaatctggtgtcctttccccaagagctggacaaatgacctcctttgaatttgaattattagctgagagaaaaagagcctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaaaaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatattaaaagctggagaaaaaaattgcagaaagaaaaatgactaacgacaatataatgaataagaattataattacagtgtccaaattgttgcagagaccaggacttagtatttagcaaggaaactgaaatcaaggtgcttctggaagatcccacacttgtgtttttctttaattcatattctagcacctacgtgggtccagtatagggacttgtttagcgtatcttttgcatttttccatacttttgccatatgtctatatccaactgtagcagtcaatttgctcttcctttctttctttttcactattgtacatgaaattggtctccttacatagccattgtgtttatttaggatgataggatgattcagtcctcactaccttttcaagacaatcactggatcaaaataactccattccattccaccctcacatgttaaaagacctttccctctgtttcttctccatgatgtccttcttgtgctgatataataaaatacctgagactgggtaatttataaacaacagaaatttatttctcacagttcttggggctgagaaatccaagatcaaggcaggagtggatttagtgtctggtgagagcacagtctcttcttccaagatggtgacttcttgcttcgtctttcagaggggaggaacggtgtctcctcaaatggctgaagggaaagaaaggcaaaagaaggtaaaagggcctagctagttccctccagcccttttacagggcactaatcacctcctaaaggccttacctcttgatattattgcattggggattaagttccaacatgaattttggaagggacacaaacattcaaactatagacatttggttgttaacataatattaaaatctcaaaatggaaatttttcctgttttttaaggctttcagaaagggatactacaacttcacttacgtagccaacatattctagtacattgttagtaattttggaagtgtttcactcatgagagttctgaagatctcttgggagcaagatgtggaattacactatatcactgataaaatgctatttgcaatgaagtggaattcatctaaagtcttgaactctatccagagtgatttgactttttaagtacaaaaagaactgcattgtaaaggtgatcacatctataaaactgaaattagaaagaacccaaggggagcattttagtgagctttcccaatatatatttttctaacttgtcctgttggctattttaagaaactaaattttattactttgtgtttttaaaagttttatgtaaaaatcaattttagcaggctggagaagtatcaagtagagatatataaaaataatattaaagaaatataattaataaatattttattacaaaggaaaaactatgaagtaggtaatcactagagcttaaagagaaataaaagggttaagaagtagctgcccttcttatttattcatgactttcattgattacttgttgaataacaggcaataaataaaaaatgaatataactattacctcttcaatggtcattcctattaaatatgtatttacacttttcctggatagatttccaacttataatttaatgcattccaatgtgtgccatgattctgggctgcttttataaatttatgtttagtatatgtgactattacttttccccataacgcttttgctttttatcactacttaagcctttgctccttctgcttttatctaaaacattttcaatttccgtgggaagagcagagattgaagcttctcacttctccgtgtgtagttatgtttctaacccaggcagattccctcactgaattcccgaatttcaggaccttacagttctggggaatcttgctacaacagaggaaattacatggatgtcagtgtagaaatacgctttcaattagagcctgaaaacacatttgaagtctctgttcattgttgagagacaaaagaaaggaaacagatgatgggctaatgggaaaagaagtatgaggagaggcatccatctctgaaagctgagtgagagtgagaagtgggctacccttcacttactggccatagatatttaaaatcattctatgagatactgtggagagggggctgttagtgtgaatgttcaaaccaggctcttccaacagacatagtgaccatgcctttgggggctgcctgagggtatataaagaaggaacatgcccagtatcatccacattgtctattgagaacttttccagtggtgtctctggcatctgccagctgttgttgctgtagaatctagagaaaggctaggattccttttgagtattcagaaaaaaaagtatatttacaaagtgtagaaacagacctccaaacaacaacaataatgcattaataataaaccatccttaatattgatattattatactatcaattattgagaaacagcaggcaaagtgattaagtgtacagacgctgcagccagacacttcctagctctgtgtctttgggaaaattttgttttgtctctatgctcttgtatcagttggggtatgctgggttgtgctatagtaacaaaaatctgaaaatctactacaatataacacaatggcttatttcttgcttgtactacatgtccatcacaggtaagtaatggtcactcaggaacacaggctaatggggactccatcccagcaaatacttctacaatcccagaggtagggatgcaaaaatggtctttaaaagcttctgcccagtagagtcacatgtcccttccactcacatttgactggtcaaagcaagccacagtcaagtctgatttcatggagtaggacaaatgtaaaccttctcagggaagaggagcagatattggtaaatacaatctaccagtgacaagttcttcaactaccccttataatgtggactaaatgagtaaatatatataaagcagtatctggcacatgctatatgagtgtttgttatttttattattaaaaatgaacattcagtgcttacaataatcaagtgatttttacacaacattttaattacttttaaggataaccctgtaaatttactcttattatacccattttacagataggggaaatgaggctcaggaggttaagaaccttcccattggcatacaggaagtgagtgatggagcaaggatttaactctaaaggccatgttgtcatcccactatgctatattgtcaaaatactgacagcaccataatagtaatggtttgtattaactgagcactttctatgtatcaagtatcctaccaagtgttttatatttattattttacttatctaagggagtgagtgtcctgcccatctagcatgaatatttcaatcaccttgacagaatatgcctactgtcagtagtcagtggttagtgcagaaagctacagcgagagagtgtatcttgagaataatttatttacaacactatatttacaaaacaactctcttttctcaatctggtttcccaggtacacttttctagtggaaaatagaatgaattgaccaagtggtataactagttccatctgcccagtagtcacatttctctttgtaagtaaatcagttaacttccttttttatttgtccatctcctatgagcttggttagcatgaatcagcttcccagggcctgatcacccctgagcgaatggatacagttgagtccttggacaggtacgattgggaatcacggaagcaaagcaaaacaacaacaacaataccaaagcagaagaccagacccaggacccctgagagcccagccagcctcctcttgtttctcttggacagctttgctattcattggcttttagtctggacattgctagctgccatttcttgatgggacagaggaagttcaagagccatgcctctagcaaaaactttacaaaggctatactcctttcatattccttcctcatgccccctcctccacagccacagttctactgttcagacctacaatctgtcctttatcaactgaggagttacagcagaatctattctgtgtctcctctaggcaacatttacttcttcaattttcattttgttgtaaagtttatttcaatttttttgtctattaaacgtttaaaaataatgttggaattttggcaaacagttacggttaacagtcatgccagaaacatttggtgaacgcaactgggaggggcaaaatagggatgaagccaaaattgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatccgtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttctaatccataaattagcaaacaataatttaacaaatttttatttcattttatttttggtgaaaccaaatttattaattcaacaaatgtatctgttacgtctttactaggtgacaggctttgtgcttgggaatgtactggtgaataaaaatgtggccttctggtctcagagctgacagtctagtgggggaagctgtcatttaacaagcacatgatgtgtgttaaatttgtccttatgatgggtgccttaaaaaagtgcatgacactatgagagtgtgcaatgggatttgacctaatgggagaggccagggaagtattccacgaggaaataccagtacagtggtgagtaaatattccagcctttcatggattccaaaaccctgccttgtatcttgatacttgagtgtggttgccaaaacaatttgaaaataatggtgaaaagaaaacacatcaaaataaagatgtgccggacctcttcaacatggtctggggagttctaaaatttctgccttgctcatttaattaccactcattagcattatggctaatttgttattatatcaaatctggccatattaattacaaattaatttaatcatccaccttctaaaatataatctgcagcgaagttttataaccatgtgtatccataaaattcatttaatagcttatagttacagaggaggatgttataaggttggtttctgagaaatttctacaatttaaagctgaaaagatgcagagagagagagagagttatataatatagaatattagtattagtgttagatatatgggtaaattttttgaagtataattgatgcatctataatttaaaaaaagccacaagtttaaaacattatttcaaacagctcttatccaacaatataggacagtttaaatagaatgttaatgcttcttagcaataggcagactggttacatggtgtccagatttctgccttgggtggctgcatcccagctgtgctgcccaggagtttagtagagataaaagccgggctgttgacatgattatggaagcacacaccactttatctccagtagaactaaatttagcatctcttggaggtacacttttttttttcagatgaaagctgcattttataatgaatctgaataattcaaaagtggcaggatcctaatgaatagatgcatcatagaccagaggacttggctccaacttgtgaagttattgaaggtcttacttttctttcaggaaaattttccttagagaaaatttgtttcttacacacagagttttagcctaaggtgagttgtagcttaagtgagtttgatgtcttaactctgcattaagtatttcttacagtgatataagtggaaagaaaacattgataaccaaattgtttcattctggttccttacagcccttgtaggttttatactcacaagctccttttctgatattgttactcaaggaagacaaaaatgggctacatctatctaatttccttattgttaatccaaatcagagcaaaatgagttcacttctctgaatgtgtgtgtgtgtgtgcatatatatatctatatatacatatacatatatacacacatatatggtatgcacacagacattgtcaaataaagtcaaatctgaatttagatagagaatctgttcaaaagaattatcacaataaggagaggggactactgtgataggggaactattgtaatggggagaatgctcctaccttaagatctgtaagcatttgaaaggccaggcagaaaggatttttcttttatagggaagggcacagaaggtcagaaagaagcacatatgagggagtgggtagcgtgatcccacagttgatcctacagtgaggaaacatctttcctgtggtcagtcctttcttggtaagaggcgattaaggagaggctgtgtgctgtctcaggatgagagtgggtcaaagttccagggcctaaggggaagagagaagcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcattgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccgcccttgacacgtggggattattacaattcaaggtgagatttgagcgaggacacagccaagccatatctcatatataaaaaatttttatgaaatataaaattattaaatatataaaatatatacatataatatataaaaatatacttattaaatatataaaaatagatacatataaatatataaatatacatgtatatataaaatgttatgtgtgtatatatgtatatgtgtacatacaaatatgtaaatgtaaaaatctaaagaataatttaggttaagcataatgaaattagatgctacttttttaaagtcatattgaaaagatcgtgattatggagcagcaaaaaagttaccctggagtcataagtggttattttccagtttaattaaacatttcttatttcaagtagatacaatgtgctcaaagatacatcaaatatgagattacatactcatagtaataggccaggaggataaatctttttttctccttatttcccactttttgtaaaatgattttgtactattaattactctccatacattattgatacttttagtatttgtggtaagtgaagatacctatctatgaatgcaggataattaataactgaattttccctttaaggaaaaactcatggccttatgagattaattatagattctttgaaaaacgtatgcccttggagttttaaaaatatgcttaaattcataaaaatttacacataactcttcagataactacttgaataagacaagaaatacggatcattataataattttattaatgctttgaaaaaaggtaacttccagaaagaaaagactctcacagaaccatgacttagaattaagtattagacttttgcatcattgcataatattatggaaaggttaacaagtcgttatgtagaagctccagggtttcagagacaaagaagagaatccttccctatgcagtgaaatacactaacccctcatgatgggatttgtaaatctgccaggacgaagctatgtgttctaaaaatagctaaagtctttgagtgtttatttaaaagataactattctcaatggatttttgagtcagttatactgagggatggaaagttcttaaattgctttacaatgtattccagggaaaaaatattgcaattcaaatctctcagagggattccttaatcaactagaatattctggatctcccagttgtcagctactcagcagctggccttatgaaaaaaactagaataaaactggttcatgaatgtgttgcctgggaattttccttttcttgggtcaaaaaacattcctgatcaattacaaataaatctagtctcagaaagttgagctccttttcttaagcatgtgttaagagacatatttttcatatacatttaaaatatactggatgccctgaaaatatgacttgggtttcagcaacaaattctgatttccttgggtcagaaatatgggtctctatcagtcattttctgttttttttttctttttttttttcagattcaattgggcttcacttttttgtaagcaaagatatatagaaagggaaggttgaatgtgttagaattactcatgttctctggtggtacattattgtaacagaagtttattcctccaaactgcttggatgggcacaatttgaacatatgctgaaacagtcctatagacacttgagagttccatacagtttatttgctggtgaaatcatggatggttacacaccgcttcctcattcccttaccttccagatggctctccacacttaccacacatgttgcaggaaacaggttcttgtttatcgtgggtttgctatcaaccaagaaactgatatctaagactgctaaaaaacaaagctagcgtataaagtcttgtataggaaaagtatgttttagaggtaactatgtcctagtattaaatctgagtaggtgagactgaagcttcttaacaatgtatattgtgtatcctctgagtcagcccatagagtctttacatgtactctgaaactagagagggaaaaagccagcaacttccttcctgttctcctttatcaatagtacattttagcctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttatcaaccatactaaatcattcggtcatcctctacttaataaccaccaccttaaaaattgctgggttcatctcaggaagcataattttgttctagagattcttctctggtcagaaagagagagagggagaggagagagagaaaggagcaaataataaagtgactactactgtccttcctctttaaataacagctcctgggaaggtcagatcctttggctgttttgtcaaagatactcaggaaaagttttcatagagatctctgaactacaggagacttgaaaattaattacatgaaactttatgaattttcattgaagttaaacatcagcacaaccagtattattttcctggagcttttgattagacatttctataccagtttgtctgtcatttcttttttgcagcataaggtttaacagtctaatccctgaattggccagagctgctgcatactcctatgtcaattgtgcactgcacaaccgtagggggtgccattcccactgaatgcatgtgagtagtgtcctctggatttgtcatgtagttaccatgaagttgtcagtctaagcatttttctgtctctaaccttttgttctccatgaagttttgagtgcctttaactattattacattaattataattattgtctaatgtagtgattttccctactaaggtttacatttaggataaatcttcagtcatttcaaaaggattcatatacagtagtgtgtcttcatgtgaaactattgttatttgtgtattgaagcacagtagagaagcccaagaatccagagtattacatacatcagatgaggaaaatgtcaattgtaactcagctagatcttaactttgattggttttgacaaccaaacatagttgattcagtttgtaacttgacaacagaaactgtaggcatttggaaaataatatcaagtcctcttttcaaatctaatacatccttcttgtgtaagaaaatttaattaaattcatttaatcttctgaaaaaaatgctctaaattcatttaagagagttaaaaataaataaatcttttaaaaagcctaagacttgagtgagagaaatgatttgatgttagtctgttagcttcaagaaaaaatgccaagttcttgacctggatagaaggtcctctgtgatgggggctttgcttacctccgtgtcttcacattttatattctccaggccctcagttctgtttcttggaaatatcaggcagttttgggattccatgccttcgcactgctgttcctgccaactgtgatgttctttccctcctcagtcacccaccagctcctcttcatcactcacatccagcactagtgttatccattgcctttccagggaagccttccctgctcttgtccctccatacccctcaccctccaattctcatcaaaaccaaattatctcctgtatagtgccagatctgtagcttatacacaattttattcccatgctcaccaccctgactcactaaatgttaatgatgtgtccctatgtctttttctcatacaaaatcctgctccttcagggtggggactgtgttttagtacagtgctgagatttaggagaaagcagaggattacagaagctctgcaagttgttcaagatgatgcgactaactagtaagccgtggggatggatgcacaccttgatctatgtgacaccaaaacctgtccttaatatccacagtcatgatgtccaaggtcactgtagatgcctgtgtaccaaagcttgttcttcatattgggcgttgtgtccaacgtcaccattggatgcctatgtgtcatttgggaagatgggcgtttctgcagttcttggcagctccgttttctcatggggttgaaattttgtcctgtttttcttacttcaacctctggggagtttcatttttcctggtctactcttaaaaaaaataatttttgtgggtacataggtgtatatatttgtggggtacataagatgttttggtacagacatgcaatgcataataatcacatcatggaaaattggttatccatcccctcaaggatctatcctttgtgttttaaataaaccaattatactcttttagttatttttaaatatacaattaaattattattgactatagtcactctgttgtgctatcaaatgcttggtcttattcattctaacttctttttgtacccattaaccatcctcatctcccctcattccccactacccttcccagcctctagtaaccatccttctactctctatgtccatgagttcaattattttaatttttagctcccacaaataacttagaacatgtaaagtttgtttttctgtgcctggcttatttaagttaacacaatgacctccagttccatccatgttgttgcaaatgacaggatctcaatcttttttatggctgaatagtactccatatgtactatcacattttctttatccattcatctgctgatggacacttaggttgcttccaaatcttggctattatgaatagtgctgcaataaacctgagagtgcaggtaactctttgatatactgatttcctttcttttgaatatatacccagaagtgggattgctggattgtatggtagctctattttcagttttttgaggaagctccaaattgttctccatagtggctgtactaatttacattcctgccaacagtgtatgagggttcccttttctccatatcttcgccagcattttttattgcctgtcttttggatataagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagaaactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaatgagtttactgtaggtgtgtagatttgtttctgggttctctattctgttccattggtcgatatgtctgtttttatgccagcaccatccagttttggttattacagctctgtcttataatttgaagaacctggcctactcttttactcagtttcatcttttcctaccagagtattccatcttttcagaatacaggcaggctcccatatgcactggactggcaatttgcttttggctttttctctcaataggaccagtgcccatctttatttttctcctccttctggtggccatcttttgactatcaggcaactggtgactgttctcagggttatttgatataattgcacaggtttctagatcagtgcttcagctccttcaagccatttccctcaattcatgctgtgtacaggcatccatatacatatgtacacagatatcctgagtatacattatatacaatttttagtggccctattctacattctactcttctagtgcccatgtttgattttttgttgttactctagaagaagcacacaaaatgtgctcaagatgtgaactgaattatatgaatttaaatctgtgaaaatattaacaattatcccagtgcaagaagacattggtcactattgcctttggttgctcataagaggataaaaaaaaagacactttaactccctttaggtttattgtctttttctagcatggttcagatattaacaatcaaagtgactgaactttagattttttatatgatcttttcttaaaatctgggtaacttttatctttgagtttcttccttcctttgtgaatcatcaccatcttcatcactgccaatctttaagtatttaccaagaactcatcatatatctagtgccataaatatatgaaaatgcttttagaaaatgctctcctccccggtattcacttatgctccaaattggcaaaccctttggtctcagttacacttttggaataatcctctcatcttgagatcatcattatttctattcaataaactagagaattattgtaaaacaaattgggtataccagaaagaagtgggacattttagagaaaatcagaatattcaccataaagctggaattaagcatatgactgattggaactgaatttgttccagttttaaaatatatttttaaaatgtaaaatacacttaacaacaaataatcacttatagttataaaatatgtattctctctagacagtgttctaagtgttttgtacttattaaatcagtaaattctaatagcaattatgtgatatatgtacacactattatgatatccattttctacaggagaaaaccaagggacagaaaggttagctaatagctaatgagtggcagtgccatgattgaaacccaggcagtgtggacccgcagtccttgtccacagtctgacaagactgccccacctggtccatagctgtttcatatacaatgaatgaaaaagctcaataacaatggtaaatccacacttcataataacaattaaactcctgaacttgtaaatatataaaagcagagagatagatgctcatcttcagtggggagggaagggtttgttattcatgttacaataggcaaactatccctcaattttaaatacagaggattctagtgtggttggctgtagataacaagtccacttgcaacagagattggaacattaggaggggttgactgttatggacttgatggtgtccccttcacaaatttctatgttgaaatcctaaacccccagtatctcaggatatggctgtatttggagatagggcctttaaagaggtaactaaattaaaatgaggtaattggtggggcgggggataatccaatatgatgggtgtcattataagaagacaaaatttagacttagacaggtacagaaggaagaccatgtgaagacatagggaaaagatggccatctatataagccaagcagtgaggtctcagaagaaaccaaccctgccaacaccttgatatgggacttttagcttctagaattgtcagaaataaatttctgttgcttaagctacagagcaaacctcgctccgtaacctgttaggaaccagaccatgcagcaatgagcattgctgcctgagccccgcctcctgtcagatcagcagcagcattagattctcataggaatgggaaaccaattgtgaactgtgcatgtgaggaatctaggttgtttgctccttatgagaacctaactaatgcctgaggatctgaggtggaacagtttcatcctgaaactatgcacccctctccagccccccagtccatggaaaaattgtattccatgaaaccagtacctggtgccaaaaaggttggggaccctggcttaagccaccctgtctgtggtgctttgtcatggcagccctagcagactaatacagggacctaggaggagaaagctaacgtttgagtttcctagtgcaaaactcatcaggacacaaacttaaaactccacaattttctcttgatctttggcagaaaaatgtaatttaattaggatgcatttttatgtaaagtggggtgcccttggccacatgacttgttctttatgtgggcagataggacagtctccttaaccagcgtgattagaatttcactagcttatcgctcaacaaatacacacattgttactccactggcttctgcctttcccagatatacctgtcataatataatgtaattaaaataattataattgtctgaccttgaaattactaattagcatgatggtcagtcctttgataattttctccagaaaagtcttgttaaaatgggcctgcataaaaagctgggggcaatgaactagttataaaaggataggctaatttttggttaagttgactattccttgccagaattaagaagttggaagatgaggtttcttgggggtggttagtcatagtcctgggaaattgggacctaggctgaggggagtaggaattcagtggcactcaattaattttttcattcaaaaaacacaaacaaagcctttgattcaacaaacacaaacaaaatcttgctttggccgggccctgtgctaactcctgggatgcctctatgaacatgatagaagcagctactgcattcagagtttatgttcttatgggagatacagatgttacaaagtacaagccataattagttattttggcttgtactttgtagagaatgaaaaataattttatttaattcattatcttgctgaaggttggcactttttagcccgtgctgtccaatgcagaaagcactagccataggtgtgctattttaagtaatacaaaataattacaattgaataaaattagatattccattcctcaggggcattcgtcacatttcaagtgctcagtagccacatgtggctagtgactaccataatggacaacagagatacagaatgtttctgcactgctgaaagtttcaccagagaatgctatctgggctctagagttgtgccagacctgcaaagtcaagaaagagggcccttagcttaattccttagagaacagaagatatatatatttatatctaccaaaatagtccacttttggctgcaggccatagtataaatctcatcttagtctggccttcaaaatgaagaatgggctggttttaaaccaaggacagatttcctttcctcttagtcttatgagtattggggttttgcattttgtgagtgctcatttttgtatgtatgagcaatttgtccataggaactaggggatttttatattttttccttttatttaaaatatatgactacataaaataaacaacatgtggtttacagatatgaggagtattggaatctgttactttaaaatagtatagcaatgtttggacttttcacagctgaaagaattaaattcagcttcagtaccaccaattcccattttttttcaagtacaagagaaaaaagaagaaaagaatatgtgggtggagaataaggaaatcagctgtgttggtttaatacccttgaaggtgacattagtagaagactttattaaaacatgcaacctgaagctgaggattataaaatataatatgtcatggtgggagatatgctttggctgccacacctaaaggtcactctttgaagggagctgagacagctgccaggatccattgatttctttctagtactaaaacatcctctggcaggtgtcagcctgggtgtgtgaacaaaaaaatatggaaaattaaagagtaagcaaaaatgggccatgggatcctcctagtagaccgagcagaatgctccagtgtttgttctgaacagacgtgtaaatttttgctttagcgacacaacagatacatgaagtgttcaaatattagtcaacatatattttctttagtggaatatagcttctcaagtctctaggataacaaagttttaaaatcctgtctaggtgtatataattctttaatttgtttctagtggggctactccctcaggttaagtaggacactttccctacaatagatttcatttttctttgattagtttccacttactccttctgctcctaacatggccatccctctgcagttctccaaatatcccatgtgtgtgcttgcctctatgtctctgcatacaccatttctcttctgtgcttaccccccaactcctctacaatctagaagactcagccttgagatctttttgaacaagaattgcatttatgatgataaatctgtgcctgtcctacaaaaaaagcccttgtctccttctgaggtgattttgcttagtggctaatcttttcaactttttgtctttaggttttgcagaaaatgagaaaagatggaaagagtgagaggtcacatgatttgctgcctgggctgtggggaccacccaggggctgtgtggagggaaccatccctacgttagcgctgagctcataaccatgacgtcaacctagattccaaatctaggtgctcacattcatttcacaccattagcaagttaaaaatgatagagccaggccaagcgcggtggctcattcctgtaatcccagcactttgggaggttgaagtgggcagatcccttgagctcaggagttccagtccagcctgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtggggggtggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctacctaagtccaaagcaggggagccacctgctggacagtgtgaaaaatcttcattttctggaggtagtcatccctgcttttttacttttaagtttaggtagatttacttacatataaatttatgtactttttattttgctgagtaaatttctcacttcacacaaataaagcggctctaaaataaggagaaaaaaattaggatgctatgaaacacaaatttgaacaacgatcagtactagaagtagaggcttttagtcattccattttgtattttgtctttttcctttcattcgtagttcagcctaactgcatttatattgtaaaccaaaaataaaattctaagccccttaaccgactgaatggacctgtcctatggggacaaggggattccaaaaaattccaaaaagctagttcaggccatgatgggaacctgatggtgtaaccacccagttgggttcacctttcatgctacctagaaagagctgattcatctagacaggggaatcgcaatagagaaagaataattcgcacagagccagctgtgcgggaatctggagttttattattgctccaatctgtctccccaggatcagagtttttaaagacaatttgtgggaggggaggggcagtgagtcagggactgctgattggctgggtcggagatgaaattatggagaggaaatcatggggcgttactgtcttcttgcgcttagtccgttcctgggtgggcatcacaggatcagatgggccaatttcttgatatggtggtgccagttgatccgtcaagtgcagggtctgcaaaacttctcaagtactgatcttaggagcagtttagggagggtcagaatcttgtagcctccagctgcatgactcctaaaccataatttctaatcttgtggctactgttagtagtcaagaaggaggtttattttaggaaagggatgttattgttcttgttttaaaccataaactataagttcttcccaaagttagttcagcctatgcccagcttggaggttagaggcaagatggagtcatttaagttggatctctttcactgtctcagtcataattttgcaaaggcagtttcaatggtaaaagggaattggatacgctgcattatactttcctccctttggaattcaggctgaactgatcggccttaaaattaaaacagagatcttaagacacagtaggctctttgtagcaataagataccaaattccaacctgactccagtatagcatcacatgacagatagcaggccctgagaaaaatcaagtattttaccccaaaatatatttctttgacatatttttaaatggccctgcaaagctatctcttgtgggggaaatttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgagttgttctgcctttccctaccaaaccatgattgatgtcttatgtcctcctaaaatttaaaatatcaaactgtaacccaacctccttggccacatgttctcaggacctcctgaggctgtgtcacaggtcatggtcctcacatttggctcagaataaatctcttcaaatattttacagaatttggcttgcttttttcatcaacaatatgtatacaaacgggcttttctaaaggactttcagccctccttcagctcatctccttcctctttctatctcctcgcctacatagtcaaacttcttaacagggttgtttatacttgccgaatccacttccttacctcccactcacttcttagccaactttaatctttcttcttccccgacactccattaaatcattctcaccaaggtcaccaataaccaccttgtcacaaaatctcatggacacttttccagtttttatcttttttgactagttgggaacattctacgtggctaagcactccctactttttattttttttaatttttttgagacagggtcttgctctgtcacccaggctggactgtggtggcatgatcatggctcactgcagcctcaacctgctgggctcaagcaatcctcctgcttcagcctcccaagtagctgggactacatgcacatgccaccacaccctgctaattttatgttttgtagagatagaatattgtgatatttcccaggctgactccccacttcttgcaacactgcttctcttgatttctgggacaccacccccttctctcttcttcctacatctctgactctttcttcccagaatcgtttgcaggttccctttcctctgctattctgttaaatgctggtatttcttagggttctagcttaggctatcttctcactccaccttctgtccctgggggacacagttcatgcaaagggttttgattatcttcaccatgctgtcaaatctcaagtgtgtatttttggcccaggtgtcactctctttatctcttgatgatccctgctcatcctcccatatagtttatatatcaaattacctcccaggcattgtacctgggaggtcactcagccacagcaaggtcggcatgtctccagctgtgcttatccctatccatatgtcctgcttatcctcagtgacacctctggaattcctgcttgaatgaataaatgacaactcagagttatccaaacctaaatcctgggggttatccttgatccttttcttaactctccacctctaattggttagcaagcaccgttgggtcaacctccttaatacctccctaggaaacttccattcccatagccgtcaccttagttatcttcatttatcacctgagttagtgaaaagtcatttctcctctatccttttcccactccatagcatagagctggagtgatctttttgaatgtaaagctggtcatggccattctcccttcctaaagcccttccagggcttcccacagctccttcttaacttctcttctgaaactcattgtggcctgtcttctcagctcccctccttcccctccagcttcgtctctcattgccttcttcttccatgcactactccagccacatggaactttctccacttcctcagtggcaccagggatgctttcatgctgagtagtcacatggactgtcccttcttccttgaaagtgtgtaaccctgcttgtacccctgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacagtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaagcctgtcatttctcatttaaaataaaacgggactcattcaggcttcttgaagtgagactgcatgtgacgatgcagggaacacatctcctagaaagaagaggagccactgaatgggcagcctcatggaatctcaggctagaagatccttcacatttgaagcaggctttagaggactgtgttatcttttccttttccatttcccctttccttgccttaagagcaagaattgtagattttcactctagtgctgtgggcttacaggggctcagctctgctggtcttttattcctctctatattttctagcacttcattctgttcacaaccaactaagactcttagaatttttcagtttcagtctcagaaagagttaatccaattggtttgtctaattgctgtcattactgcctggcatcaggacatctcataggtcactggtcagctactgattggccacacttgggctgtggtgaatccttggtccaaccagttttggctgtggtggttggttcttaccttttagagcagggccattccaactcaaggtcagcgtggggctgttttctttaccagaggtctgtggacatggacagcattgcataaggcctgacaaacttctggattctctacatggtgatagtttaaagtttctttaaaaatgtgtttttttgggggggggagtccacatattcaaagttctaagaaatctcaactactgacatattaaggaattgaatatgaatgtcctctcccactagatactgatagtttgattttcacagtaagatattctgggaagaaatctggataggaaggattagggaggccttatcatgacactcacaaagttgaatgggtttggtgaatgtatggtgaattttttccaggcatatatacttacaaagttgatttaaaaataagaatgtagattctggatattagccctttgtcagatgagtaggttgcgaaaattttctcccatgttgtaggttgcctgttcactctgatggtagtttcttttgctgtgcagaagctctttagtttaattagaccccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcagatttgtcaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacatgaaggggaataccacactctggggactgtggtggggtggggggaggggggagggatagcattaggagatatacctaaggctagatgacgagttagtgggtgcagcgcaccagcatggcacatgtatacatatgtaactaacctgcacaatgtgcacatgtaccctaaaacttaaagtataataaaaaaaaaaaacttccaagtaaaagaaatctaaaaaaaaaaaaaaaataagaatgtaagagtgatggtatttgacatttagaagaaatgttttgacaagtgcatgtgatgatttaatggtgcatattccataaagtcaacaggagtgaagctgtggaaatgtttgtctttctgagtgagtggtatttactgctgtgaatttgctgttccatttcccaatacactctccctcactcatgcttttactctaacttcacgtaactgagttgctattttcaatgatgctagtaattaatgtgtgtttggattctggatttttaaaaaagtaataagatgttttgggacaactggggaaatttaatatgtactgtatatcagatgcaattcctgagtgaatgttaatttctttggggttaataagagtattgtagttatacagaatgtcctcattttcatggtctgcacactgaggtatttagggtgaagtatacattgttggatagatggggataggtaagttgatcaagccaacacgacacaatctgaaaaattgggaaatatggatgctactcattcaacttttgtgtagggttgaaaaatctttaaataatataaaaagttggaggaaaaagtgtaactagtagtctgttggtgtagatggcttgagtctgagatctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctttggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaatttacttgctgaaatccagcactgtggaggtggtgaagcagctgaagccatttttgtgatcagttcactctatggtatactgttgttattgtatttgcacttttgttctggcatgtttgcagaattactttttggacggatcaagtaaccaataatttgagcaacaatttaacagtaactttttagagtgaaaccttaccaaccaaataccagaatgtatttaaaaaatattttgctaatatttgtaactatcttgatagcctttgctctggggtttgggccatcctctgtctctcaagctgttataaatgatattttttgaaatgggaatagcatgagttggtcaggtagagatttctatagaagctccttctgtattcggcttatgacactcatggcggtagtatgaattcagatctcagggtcatttattatccatggaaagttaatttgagatgttggaacttttaaacagtgtttgtttattgtgctaatcacgatctgttactaaatttcatttgaaatgcaattaattaccttcatcaccttgctaaagattgacattaatattctgtcctatcctattagttctgttgacacagagggagatgatcacaataatgggaaggaaagagcagagagcaagggaataaacaagcagtgactgctattattttattgaatggttcttttgtcaaaatgactgcaagaaaattcttagaataccagtatcatcacacaaacctaaattcataaggcttcctgcagttgaatcatatttttaaagtttagcttggggttttctattattcagctcactggtgttgaagcaattttgttgacattttctgtaagtggattaggcttgcagtcatttgcccaaagcagacagatggcttcttaaacagagcacccccgtaggaacctatcttatggtatcttcagaaataaaacaggtctgtcacaaaagataatgtttggcattaatttcttttagtgacaaatgatttcagctcatttttactttctctgctggcttaaatgaaacagctgttttacattttttattccaatagtgagcaacgctttggtgtttgacactgaacaatgttgtagcctctaaattatgagtaagaaaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcatcactcctggggttccactcgtcagctagtgtgttctgccatcttgggcagccagcttatgtggaaggcttgtgggggctcatgggtgctgcaaggagaaatcagtacaggggccctgagaattgactgatgaggcctcacattagtagcatccttcaaaacgttcagtggatgcctgtcatgaatatgattcattaataatcttctttttggatctgagccatcagggcttatgacgatacctttgaagtgaaaaccagtccttttttccagcacttatcccactcatgaatcctctatcattgcttttgtatttcagttttccgaaaatctggctcagattaaaattattaaatgcttccaaaccctgtacccacactgaagacaaaagttagaaatcaaaatatcagcacaaggatagtatttatgtctgggacatttgtgaagttctatcaagaaattcttttataaaccaaagaagtcttaagctagtttttcttttctatttgatcaaatagatctatttgatgacatgtgcaccatatcatgtaatgtacctaaattaaataaaaaaacacaaaaaaacaaataaacaatatagagattaagaaaaacaactcttggcctgggaagccggcattattcatttccttcacacttatttctcgtgtgaacctgggcaatgtatttttttagctttcctgtgtccatttattcacctgaaggttataaaaggagtccttcgaatggctcgaaaatttgaaataattactaagaacggttatttagcagatctcagtgatactgtcactaaatgacactttattgttttccactttcagtgtttctttcagtataaatgtcaatgaaacaaaataaatcctaaatagagaaaacgtaaggaaaaatggaatgtattaggcaatttggtgctgtgccataaaggcggtaaccttccagaacactctcccataccatgtatatctgtatctgtaagactggaggaggattcttgcctctcctccaggcaagcataaaaaaatccttgtactgtgtttcactgatcataagatgccaagaaataaatgaagatgcctgctcatcttgcaaatcattgctttcttgttactttttatggggaggcttgtctaatctcctagtcctcacagcaatacattcttttccctcaagtacttagcataatttaaggttagatataactttatttttgtggttattttatatatacctgtatcccacactagaaataggttccgtaggggcagggatgatgtctgtgctcacttttgtaacccccagagtccagcctggtgattctcaatgggtgcagtactgccccctaggctgtgttctgggaagttgtagaggtgattgggaggattctcctggcatttagtggaaacagacaggaatatttgatgtcatgctctgggcagggcagtacaacatgatgaaaaatgtcctgtgtcctgcaagatttctgttaagtcctgcctgagtaaaccctctgtattagtcagttgtcatactgctataaagaactacgtgaaactgggtaatttataaagaaaagaggtttttttgttttgttttgttttgttttctcagtccttcacgctgtacaggaggcatggctggggaggcctcagtgaacttacagtcatggcataaggcaaaagggaagcaagcacatcttcacatggtggcaggaaagagaaacagctaaggggaagtgttacacactttcaaacaaccagatctcctgagaacttactatcacaagaacaacaaggaggaaatctgcccctttgatccattcacctcccaccaaatcccctcctgcaacaccagggtttacaattcaacatgagatttgggtggggacacagagccaaaccatatcaccctctaaaatacaaatcagaatactttagtatatgatattaattaattattattattttttacaagaagttgtttgaaggccagtacttgagtaaaaggtagttattgagaggtaagtctaaatgaaataaagacattgtttccaaattattgaataatttactcaccttgggtattttgtccacttgaccatataattgctacacagtaatattggaacaaattgggcagtcagataatggttttaacctgataccttattttttattattgataatccatggtgggcatccgcctgggccccacaaagtatcagctggtattatcaatcacaagaacaatgacctttggagtacttttaaagatttggcagttttgctgggcgtggtggctcacacctgtaatcccagaactttgggaggccaaggcaggtggatcacctgaggtcaggagtttgagaccagcctgactaacatggagaaactccatctctactaaaaatacaaaatcaactgggtctggtggcctgtacctgtaatcccagctactcaggaggctgaggcaggagaatcgcttgaacccaggatgtggaggttgctgtgagccaagatcgcaccattgcactccagcctgggcaacaagagcaaaactccgtctcaaaataaaaaaaaaaagatttggcagttttgatgtggtgtatggacattatttacttcctcatttatgggattatcagctttttctttccacagtgagggtttgtatttgtcttggcatgttatgccgaccttaattgaggttgtttctttccttcttttattctatgcaaatacaactagtctattgccattatttgttttcatactagtgtctgtctctacatttgcattatcattttccattaaatatgtattttttgagtggaatggcatctgatcttatttctctttcatatctaattgcattcatattaagtacaggcatctgcctacttcaggtttctggtgtgcctgcctgacattcacatatggcaatacatgttattttattttaaatgaccattccctttttctcctttatattacagctagggtattatatttattttaataatacatgaataggttatattatctatgaatttaagtttatgaaaataaagaaagccttacaaagtatttgtttcaaagggttggttttgatagattgagaacctcaggccaaagtctggtatacagtaattgtttaataaatatttgtttgctggataagtgaataaaatgaaaactaaggtgcaagtcctcattaatagctaagagaccaccattgtttccaaagcacagggaagagatgggtgtatctcagttcacatatacatagctttgaacaaggtataacagggacaataaatgagaatttgaaacattaaatttcatacttttttttttttccccgagatggagtcatgctctgtcacccaggctggagggcagtggtgcgatcttggctcaatgcagcctccacctcctgggttcaagcaattttcctgcctcagcctcctgagtagctgggattacaggtgcctaacaacacacccagctaatttttgttcttttagtagagacggagtttcaccatgttggccgcgcctggcccatacttcttttttaagctctggtcaacaagtgcatctcaatgcagtgggttttattgagtgatacagatgttttccaccagtaacaggacctattgtcagcattgttgccactggattattaatggttttttaaattatattattattagtgagtagtgtttaaataatgttgaaagacttcacttatatgtagaattctatatatacaagaacataaaattgtctccttatattaaaactattttaaaaaacatggctaatacaaaggttttctgcttaaaatgcagttaattactattttgaagtaactagggtccttcatttcttcaacattcaagttaaccaagacttcttgataaataaagctattgtaacaaagaaagcttgataggaaagctattgtaacaatgcaggtgttatttgagaaagaaatgtggtaaaagaagatctttcaaatttctttcaaatttaattttcattatgttgaattttaacagagtatgatttcaaaattttctgagcctttcatatggcttattaaacatgtcatctgctgcattttacaattttctgtggaccctttggcattaaattattcttaacatttctttaaagtgtcttctatactttataaattattttttcttgagaattagattctcaggaactaaaaagatttatttatattcagtttccatagttttcagaagtattcaattaatcagagtttgtgaccaatcctaaaatacatcctttatgtaactaattaaaaaattaactttatatacagttacaaaatctaatgtctcaggtgagcatgtccagtgtaattctcttcatgttcctgtacagattatttttattgcattatataataaagatttgaaaagcagagtttcatttgttttgggtttagagtttcagaagaataacagataaagcttcattcagccaagactgttagaacagaactactctacgactattcatccatatttcttgagtgttcatggagtaaaaatttaactttttaaatagcaagtagaatgcagttgaaatatttggttgctgaggtgttgcaaaacagtaaatctgagcattgataacttagtgcagtggacacttctatttttgtgcaaaattaagttatattatatgcaatttcctaatagctgcacctttgtgccttttaactcttgttaacatcttgtatataattcctacacagataggccttcattctagagagcaagaattccaggccatctttgaatagtttcacccagttttccaaacagcgtaacataccaagagtgtaacatcaaaaaaaaaaaaaaaaaagtctaacatgacatcaaaacatttttgatttgttgttttaatttctcaaatgaaggacattgtagcagttgttttacctcttcagagcaaaggattaaacttcttaaatgatagagtcccaacggatggtttttgaattagtaagatggcagttgtgcacagccctccacagtatggtccatcaatggaccaaataaataactactcatcccactatgatgtctgtgactggtttctactgcagcactgtccaagggtgattctactgtgggtatggactctcccatggataaaagaatatcagaaaacccagtctgctgatgagtgtgggctcaaaaatactcacacgagttgacttggagacagagctgcatttgtttatgtgtgtagttttgtatatgtgagggttttcctattcccagagtcccaattagctgctttaaatatttgtggtgtgctctgaaacaacccactcatttcctttacacttgatgagaacactagttatgatgttctcctgctcttttgtgtactaatatcacaagggatagtgcggttcatgggaaaagtgggtgtgaaggagcctgggatgtcttttgtgaataattctgccagactgtagtcaaaaccattttcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgtgacaatatttcttgtcagtagtaaatttattagtagtaatcaaaattgtggtgatatatcaccacagcaatgcacggcagcccaatttgcaatctaaattgcatcagttatttcctgatttctagataatgtactttaattataatttaatgcagttggaaagatttaataaggaatgcttaatgtttgttttttaaatattcactaattatcactcatttttaaattcagaatttctataatgatctctgtggctttgcatgagtccatgttactttctaaatgtgttggacctgccagtggaaccttacattcagaagccaaatcactgtggaggctaaatggtggccattgctcttgggacttctattagtcttgttgtcccatcagcatcagtctacctgaggcgctctctattaccctcactttcctttgagttaaagcatccttctcttttttttttttcatgaaggatccccagtaccagaggatacttcaaatccccatgagattgctagtatagaaatgccggcagcagcttgacatttttttttcaagttgagtgttcagtggtcaacttgtacattaattctgcatttcatgccataacaatcctaaacttattttagtatacaagaggtgtttccatttctatatcaccaaataaaatgaattctcctggggttcctcctcttcccttaagacctctgtttagggagaataagattaaaacactttcttaagaatgacttgttaggttactctttaaatatatactatagacgaatacctttaaatggcttggctgacctgaataccatggtgggtgtcggggggtggtttttgggatgaaactggatcaacctcagatcaacaggcattagattctcataaggaatacacaacctagatcccttgcaggctcagttcacaatagggttcacactcctgagaatctaatgtcgctgctgatgtgacaggagtgggagctcaggcagtaatgctcactcacccactgctcacgtcctgctgtgcagcctggtttctcacaggtcacagggactggtatcagtccatggccccagggttggggacacctgctgtacctaatatattttggaggaaatgatacacaggacaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgctattcctccttcataaaaaaagagaaaacagaagtttatatcatgtttcaatgtacactcttcacaacacagcctttcagttttgcttcttttattagttaatagtttacctattttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttagaaccaatgagatgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacattatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctcgtccctgctagtgtgttcttgctctgccctgtcttcctgattctggatgctatctctaaattgtgtcaggctgtgtcacatgggcaatgcttttctttttatctgcgttgcttccatgggtaacaatgaataggagtctctagggtgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactgaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccagctcagcgattaaccagctgtgaccttgggacagtcaattaacctcatcaggctcagcttcatttctcctcaggagaaggcaaaactgtccacctccaactcttcttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctccagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttgttttgcctctggagactctttttctccatctgccaggtgggaacatcatcttcaggatgatggaaaaggcagaagtaatgtgggtgactgataatttaacaacaggcagattgcaaggatgacccagtatattaaaaaccagctcaccaagcataagggtatgtgacttactttacagaagacactttgctttgtaagctcttgtacagagggggagattttattttcacttctttaaggaagagcttctttccttgttttctcccaagactaggaatgctggatctgggcggggtaggtattgcagcagtgtgcagagtctcagaccatggtgatggaagagttgatgtcctcagcacataaagaggaggattcctcacaataggaatctcaacggactgccagcaattgcatagccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 400 - DNA, 236210 bp, Homo sapiens
ccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcaggtgagtgtcgggtctggccctggcccaggtctccagcggctgtggccccgacccaggggcggagcgcccgggaccgccgtggggagcggggcgcggggctgcgagtgtttggtgccaactcattaggggggccgggcggtgtgtcgggaaacgcgggcttgggcactgcggccgggagcgctggcggagaacgggggatccagtacccgaccgggcccgcagcgcaggtgggcgtgggcatctccaatgggcgcctagcggcatggaccgcacgcccggctccacgtgcgcagccggccgccggctctgatgcaatcgcgccgggcgcgacccagacggtaaaggggcggtgcggctggggcggaaaccaggggagggggcgaggagcaggaggagggcggggctgcggctcggcgcgccggctggcccggggttcgggaagggcaagcggagctcgggagaggcgggctcgggcccagcgccgcccgcgcgaagctccctggtgttgtgcgcccttccccgcgcgcggcccctcctgctgggctggggtctgtggctgacgtccgcttttcccggaacggcaaaggtggagccgggcccccgggacagccgccggggggaatccgagaggtctcagcgctggtttccagcttcgccgcgcagcgcccacggagtccccgcgcagctgggtttgcagggttttctgcgggcccagagcgaactgggagccccgggcccggcctttcccgtcccggtccccgcccctgggctccagccttccccgccctcgcccagaggggcgcacgggtctcgggccttgcagggcgagcccttcgggacaacttgggggtggcaagaaagccccttccgcctccctcggaactgggattaggaacgagttccaggatgcggtttccccggccagcggaccacctcctccattcacatcctcttccctttccttctagccttctttcttagtcattgcctgcttgcctttctctctgcctttccttcctccctctgctctcccattttcctccccactccccttctcccatctcagtaaaatacgtttcctaggctctttattatgtggcggatgattttaaggggccatttatttagtttttcttgttctctgtcttctttttcttttagaaatggagtctcgctttgttgctcaggctggagttcagtggtgccatctcggctcaatgcagcctccgcctcctgggctcaagcgattctcccgccttagcctccagtgtaactgggaccacaggtgtgcgctaccatgcccggattattttattttattttcatagagacagagcaccactctgttaccaggctggtctggaactcctgggcgcaagccatcatccctgcccccaaaagcgctgggattaattacacgtcaggtcattaggttttaacctgcacgttgctgagactcatcttaccggttagagtctgaagccaggataggcggcaaaaaaacttctcccgtcatgctgttttattttctaggtaaactgattattacctgaaacttccttctttgctcatttcttgtctgtctcacccacctggaatatgagcttcatgagacagccgtctcttcggtgctatatcctaggtcctggagagagtgcccagcatgtaataagcacttgtgaaatggttacagaaggaatgcttcaagatttggggtcatctgtgggttttattcatacatattctttttttttttttttttttttgagacggagtcttgctctgtcactcaggctggagtgcaatggcacgatcttggctccctgcaacctctgcctcccaggttcaggcgattcccctgcctcagcctcccgagtagctgggattacaggagcacgccaccacgcccggctaatttttgtattttgagtaaagacaggatgtctcaccatgttggccaggctggtcttgaactcctgacctcaggtgatccgactgccttggcctcccaaagtgttgggattacaggcgtgacccaccgcgcctgggctattcatgcatacttttaggtttaaagccatgactgccttagagatgagtaaagaggttagtagggggctttagggcctgcactgggttctccaaactcaattccttcaggaaaatgggaggagtaacagtacttacctcaaggggttatggaaacaattatgtgagaggacacatgcaaaatacatagcccaggactgtcacatacaagacaagtccctcaacaaatggtggctattaattttttttttttttttttgagacggaatctcactctgtcgcacaggttggagtgcagtggcgggatctcggctcactgcaacctccgcctcccgggttcaagcgattcccctgcctcagcctcctgagtagctgggattacaggctcgcactaccacgcctggcttattttgtgtttttagtagagacggggtttcaccatgttggccaggctggtctcaaactcctgacctcgtgatctgcctgcctcagcctcccaaagtgctgggattacaggtgtgagctaccatgcccagcaatatttttacaattcactaagccaggggtccacagacgttttatatataatgggccagatagtaaatattttaggtttagtgatcctagaggcaaatcaaaattattagtaggtacatttataacaagagaaaagacaaatttaggccaggcaccatggttcatgcctgtaatcccagcactttgagaggccaaagtgggatgatcacattcccaggagttcaagaccagcctgggcaacatagtgagacacccatctctgtaaaaaattttaaaaaattaactgggcgtggcgcgtgcctgtagttccagctactcagaaggctgaggcaggaggatcacttgagcccaggaggtcaaggctacagtgagcggagattgcgctactgcactgcagcctgggcaatggagtgagaccttattttttatttttgcaattaagtatttttaattaaggtatgtacattttttagacaatgcttttgcacacttaatagatggcagtatagggtaaccataacttttatttttattttctattttactttaagttctgggaaacgtgccgaacgtgcaggtttgttacataggtatacatgcgccatggtggtttgctgcacccatcaacccgtcatctaggttttaagccccacatgcattaggtatttgtcctaatgctctccctcctcttgccctcccaccccctgacagaccctggtgtgtgatgttcccctccctgggtccacgtgttcttattgttcaactcccacttatgagtgagaacatggggtgtttggtttctgttcctgtgttggtttgctgaggatgatggtttccagcttcttccatgtccctgcagaggacatgaactcatgctttcttatggctgcaattttatttttgtagagatgaagtctcactatgttggccaggctggtctcaaactcctgggttcaagtgatcctgctgcctcagcctcccaaagtgctgagattgcaggcatgagccaccacgcctggctatattgtacctttcaattgagttatgtgcatggtttactgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaaatacaaaaattagccaggcatggtggtgtgcgcctgtagtcctggccacttgggaggctgaggcaggagaatcgctttaacccgggaggtggaggttgtggggaggcggaggttgtggtaagccactacactccagcctgggaaacagagcgagactccgtctcaaaacaaaacaaaacaaaaaaacccaaaaaacatatatatatatattatatatataaaatatatataatataatataccttaattataatataatataattatatataccttaatttatatatataccttataatatatataccttaatatatataccttaattatatatatacacaccttaatatatatataatatatattaatatatatcttaatatatatatataaggtaatatatatatacaccttaataataatatatataccttaattttaaaatactttattaccaagaaatgccagtgatctggtggaggatttgcctagatgttgatggttattgactgatcagggtgattgctaaagattagggtggctgtggcagttttttaaagtaagacaatgaggtttgctgtattgatggaactcttcctttcctggaagatttctctgtagcagtgctacagagaaaatggtaacattttacccacagtagtaggacttctttcaaaatgggcgtcaatcctctcaaaccctgcaactgctttaccaagtacttgatatcaactactgtaatcttttttttttttttttttttttttgagatggaatcttgctctgtcgcccaggctggactgcagtgctgcgatctcggctcgctggaacctccgcctctcaggttcaagtgattctcctgcctcagcctcctgagtagctgagactacaggcgcctgccaccacgcctggctaatttttttgtatttttagtagaaacggggtttcaccatattggccaggctggtctcgaactcctgaccttgtgatccgcccacttcggcctcccaaactgctgggattacaggtgtgagccactgtgcctgcctaactactgtaatcttataaatcctttgttgtcattttattttattttaattttattttattttattttaatttaattttattttattttattttttgagacagtctcactctttcacccaggctggagtgcagtggcgcgatctctgctcactgcaacctctgcctcccgggttcaataaattctcctgcttcagcctcccgagtagctgggattataggcgtgcaccaccatgccctgctaatttttttatttttagtagagacggggtttcactatgttggccaggctggtctccaactcctgacctcgtgatccgcccgcctcggcctcccaaagtgctgggattacaggtgtgagccactgcgcccggcctaataaggctgttttcttatcatttgtgtatccacgggagtagcacttttaaatttcttcaatagcttttcctttgcattcacagcttggctaactgtttggctcaagaggcctagcttttgacctatcttggctttcaatacaccctcctcactaagtttaattatttctcggtttttatttaaagtgagagacctgcaactcttcacttgaacacttagaggccactgtagttactaattgtcctaatttcaatattgttgtttctcagggaatagggaagccagaggagagggagagagaagggggaacagccagtccagtgaagcagtgagaacacacaccatcatgaaccatcatggccacggtttggccaacacaattacaacagtaacatcaaagatcgtcaatcacacatcaccagaacaaacatactaaaaatgaaaaagtttgaaatattgtaagaattatcaaaatgtgacacaaattgagcagatgccattggaaaaatgactcccatagacttaaaacacaggttgccacaaactttcaatttgtagaaaaacacagtatctgtaaattgcagtaaagcaaagcacaaaaaatgatgtatgcctgtatttttttttctatccacatccaccccccaactttttttttttttttggtagagaccaggtcttgctatcttgcccaggctggccttgaactcctgagctcaagtgatcctctcacctcagcctcccaaagtgctgggattacaggcatgagccactgcgcccagcccccatccccaactattttaaaagtctaattactttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccacactccggtgctttcctggacccagacaaaaataagaacccagcatagccaaattaacagtcacgacaggctggaaagagtgcggtatatgggcctcagtcacccattattggatggatggattttagtgcttatttataaggtgatttgtaaactttcccatatggtcacatttattcagcacaataatacaattaattccctgggaatgaagtagctttatcccaagtgtttccaaacaaaactaactgaaatgttcccaggttatagacagttgcctgcacccagtccatctgttccggcccagctggcagtagaaagactggtcctggttgtgaatctgagcagctctctcccctaaagccccgcctgggaactgcagtgcctctggttccatttgtcagctgtgtctctctgaaaactggggaaagcttcccgatgcctttctgctcttggcagtgtaccgttgatggcattggctggaacttcttcaccccgcatttttgttaggtgcagtgcaagaccctgtcggagactgaaaacaaaatgtaaaggtggtcttagcactgaagcctgggggctcctgtggctgcgcctttggtctattgtgagagggggaaaagccagctcccagtgctcatgtgctgctgagaacatatcatagggtggtggcgaaggtagcctctgcagtcactcatcccagaaggttccataaagagctgagctcctaacacttttttttttttttgagacggagtcttgctgtgttgcccaggctggagtgcggtggcacaatctcggctcactgcaacctctgcctcccaggttcaagagattctcccgagtagctcagattataggcgcctgccaccacacccagctaatttttgtatttctggtagagacggggtttcaccatattggccacggtggtcttgaactcctgaccttgtgatccacccgcctcagcttcccaaagtgctgggattacaggcgtgagccaccgctcctggactttttttttttttctttttttaaaaagaaattgagtcttgctctgccacccaggctggagtgcagtggtgcagtcatagcttactacagcctcaaactcatgggctcaagcggtcctccagcttcagcctcccaagtatctgggactacagtcacgtgccatcacgcccagctaaattgtttatagagatgggatctcgttatgttacccaggctggtctcaaactcctggtctcaagcagtcctaccgccttggcctctcaaagtgctgggactacaggtgcatgccaccatgccaggccttctaccacttttacctaggcctgctcaccccaggctggcacctccctcagaggtgggaggtgaaggtggctgctgctgggcatttaggaggtacaggtgcagactatgttgtggattctcagaggactgagaagctctctgtctctctctctaggaggctttgatagtgttatcaaagtgggtctccagtgtttctggaactttcctccccttccttccttacctaattccttctttaaattccaggacctggaatttatcctgtctcgacacttcttgtccaacagtgagccccctgtcttcacccccctaatcccctgtcttcacatccctcttcccactttatttgctttccccatggacccatactcagggttttgggaggatggcagcggagtatggtggaggagagcgattatttaaagtagaaacccaaagcttttattatagtaaacttggaaaatacaagagaaaaattcacccctagaaaattattgtaaacatctagtttgtttccctctgcatattttaaaaactggattgccgcattttaccttgtgttagtgtcttgatttcattgttacgccgcctaccccctccacagtgtacacttggagtgcgtccttctgtggtctagttattttcacttggaggaaggaactttcacagaaaatgtgttgtgtcagtcctttctactcattaaccaagaaatcacaatgttgttttctttctcaatgtagagaagtcattcagaattcaaaagaagttctaagtttattgcaagaaaaaaaccctgccttcaagccggttcttgcaattatccaggtaagccgagaacaaggttcagtcctactattttaggatgcctttcaatttagaaaatgattgtatacaaaagagcagctgcatttcttgccaaagaggagagggctcagttggcaatgctgttttctttggtcttttgcttctttggggtcacgggtgaagtactgccctgcttgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaataggagggatattattttccttaaaaaagtgacataatttgaaggcctgaggaattactctgttaaatactggccccaagtccctttttataagcagcaagattgtttttctgcaccttccatattatctttgtaattagatcatctgtaatcacaaaattcatctctggattatcttttgtgccttttcaagctatttttatgttgttatgttgtttttaccttcctaaggcaggtgacgacaacttgatgcaggaaatcaaccagaatttggctgaggaggtgaggactgctgcttttaaaaaattcactataacttttaacaatacattctcttatagtgacgaataaccttgtgttcctttttcaggctggtctgaacatcactcacatttgcctccctccagatagcagtgaagccgaggtaataatggcagagctctaaactcttgcttcttctttcctcttgagacttaataggcccattggcgtctcttagtggtggctgggacagatctaagatttgcttgtgactgaatgttagagggaagacttcacttcttttctctagggtaaatgcttcatgatatccttgtttcttgtcatttgtatgtttctactgaagacttgagttgcgacttgttgagttcggttgtgtttcttcagctgcggtggcagcgtcatctagtggaaattgtcaggccgaggcgaggaaactggaccttggaccacagatccctgtgccagggcccggcccttctgtggttagcttttcttcctactggcttcatgtgacagaaaacctcaaataatggaatcttaaataatgtacaagtttatttctctctctctctctttttttttttgagatggaattttacttttgttgcccaggctggagtgcaatggtgccatctcggctcactgcaacctccgcctcccaggttcaagcaattctcctgcctcagcctcctgagtagctgagattacaggtgcgtgccaccacgcctggctaatttttgtatctttagtagagatggggtttcaccattttggccaggctggtcttgaactcctgacctcaagtgatccaccctccttggcctcccaaagtgctgggattacaagtgtgagctactgtgcccggcctagaagtgtatttttctgggacatgaataaagtttggaagtaggcagtccctggttggtgatatcaccaagtcgcaggagctcaggctcctgtccctctgctctgccgcctttgtggtttggttaacaagcactttgttctgattgatcagtgaggcccagcaggtctgctagtcatttgtgagacaaagaatgggaatttgtagagtttgtatctggccttgtgctatgtaaacaagggggcattggtgagtcttatttgagtcctatggagaagagcagttctttgcagtacacagaggctgcagggatttgttaaccttccctcttttccaggatcacagggctcaggtaaagttcgttgtcaccaagaagaaaaaggaaggacaaagacaggcccctgctgtctttaaagacatttcctgaaagtcacagttctacatccatcccgttgtcccctacttagttgcctggccaactgcaaaggaggctgggaagtgtagtttttataccaggaagccttagatcatttattagcaagctaaaaaccaagagtttattactaagaagagaaaggaaactatatactgggcgataagtgtttgccacacttgccattgtagcgtggtacaaatatgaagtgttaaatatgtaacaaatacctatgataccagcagtgacagcatgcaaaggaagttgttgttcatttgcacgatacccactgtctgcagcagaatttgcttttctttctttttttttgagatggagtctcgctctgtcaggctggagtgcggtggtgcaatcttggctcactgcaacctctacctcccgggttcaagtcattctcctgcctcagcctcccaagtagctgggattacaggcgcccgccaccatgcctggctaattttttgtgtttttagtagagacagggtttcatcatgttgaccaggctggtcttgaactcctgacctcaggtgatggcctgcctctgcctcccaaagtgctaggattacaggtgtgagccactgcgcccagctggaatttgcttttctttaggttgttttgccactggtgtttttttttttttttttttttctgagacggagtctcactctgtcacccaggctagagtccaatggcgcaatctcctctcactgcaacttccacctcccatgttcaagtgattctccctgctcagcctcccaagtaactgggtttacaggcacccgccattatgcccagctaatttttgcatttttgtagagacggggtttcaccatgttagccaggccgttctcgaactcctgacctcaggtgatctgccctccctggcctcccaaagcgctgggattacaggtatgagccacctcacctggccttgacactggtattaatagcccttgattttcgtcgttgttgtttataattgacacataataattgtgcatgtgtgtggggtacagtgtggtgtttcggtacttgcatatgttgtgtaatgatcaaatcaggttagttacattcatcacctagaacgtttatcatttctttgtggtgatagctttcaagatcttttctagctgtctggaaatatacaatacattgtcattagctttagtcactctactatgtaagagaacactggaatttattcctcctatctaagtgtaactttatacctactgatggaccaacctctccccatttcccctcccccatccctctccagcctctggtaaccaccattctattctctatttctatgagatcagctttcctagattgcacatgtaagtgacatcctatgatatttgcctttctgcacctggcttatttcacttcatgttatgtcctccaggttcatccatgttgccacaaatgacaggatttcattcctttttatggttgaatgatactccattgtgtatacacaccacactttctttatcctccattaatgggcatttggattggttccatctcttggctactgtgaatagtgctgtaacaaacatgggaatgcagacggcttctcagcatagcggtttcagttcccatgcgtatatacctagtggtgggaatggctgggtcatatggtagttgtttttttaattttgtgagaaatcttcatactgttttctctaatggctatattaatctgcattcccaccaacagtgtacaagagctcccctttccacatatcctcgccagcatttgttattgtcatttttgataatagccattctagcttgatatctcattgtggttttgatttgcatttccctgataattaatgatgttgagtgttttgtcatatacctgcaggccatttgtatgtcctttgggagatgtctgttcacgtcttttgcacattttttatttgaattatttgtttttttgttattaagttatttgagttccttatatattctggatgttaaccccttgtcggacgcatactttgcaaatattttctcccattctgtaggttgtctctgctttgttgattgtttgctttgctatgaagaatgtttttagtttgatataatcccactgatgtatttttgctttcgttgcctattttgttgaggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattatagatgaaatcttaaagatcaatgaagataccagagtacatggccttgcccttcagatctctgagaacttgtttagcaacaaagtcctcaatgccttgaaaccagaaaaagatgtggatgggtaagaaaataaaatcaaataatcaacctttatggctaaatcactttttctattgtgcctgcttttatttttctaaatttcttctatttatttcaactgtgtcagtaattggataaaaaaatcattttaaatatttcaggagtctataggatttttttttttttgagatggagtctcgctctgttgcccaggctagagtgcagtggcgtgatcttggctcaccacaacctccatctcctgggttcaagcgattttcctgcctcagcctcctgagtagctgggattacaggcatgcgctaccatgcctggctaatttttgtatttttagtagagacggggttttaccatgttggccaggatggtgtctatctcctgaccttgtgatccactcacctcagcctcccaaaatgttgggattacaggcgtgagccaccgtgtctggccatctgtagccttttaaaattctgcatgcaaaagttacatattttggaaaatacattagcccttttatagtgcttcaatgccatatgatcttacaccatcagattcatttaataaattccggtctgacttatacaatctttagccagctctattcttctaatagttttttccttggtaattctaccagaccagagaagaaaacttagaaacctgattccccagcagtaccatattctgtcttagtcccaggccagttgagaaaagcaaaataaatacttttcttaatgacacaaggttttatttgaaatttggaggggaacatcataactattgggtgctgtaatgttggcctgtgattcatgtcatggagtgacataagcttcatagaacaaaggataccggccgtctccagtgggggataagcatgcttcctggggattaaaaccccattttcctccatggaaatataggaagtgttttgtactgtggccaaaaagaacacaatgtgttaatggttataggttgtaagcagatttataaagttagattccagatccggtagaccctgcaggggctggatggggaggctaccaccttcctgagacacccagcaatcttccattctagccttttattgtgacttgagtagacccaaacacaggctgaaaaggtgtcatgaacacctccagtcctggctgggcacagtggctcacacctgtaatcctagcactttgggaggccaaggcaggaggatctcttgatctcaggaggtcaagaccagcctggacaacatagtgagacctcatctctattttttttttttttttttgagacagagtctcactctgttgcccaggctggagtgcagtgacacgatctcggctcactgcaagctctgcctcctgggttcacaccattctcctgcctcagcctcccgagtagctgggactacaggtgcccaccaccacacctggctaatttttgtacttttagtagagacgaggtttcaccgtgttagccaggatggtctcgatctcctgacctcgtgacccgcctgcctcggcctcccaaagtgctgggattacaggagtgagccaccgcgcctggccccttgtctctatttttaagtaaataattaaacatttttttaaaaaacgacaatctccagtcctgtcgtagactaactgtaaaaggagaagaagcactaatccatgagaaaactttcagaacttgaaggtcctagggcatagtttcaagtctttcataaaaggaggggaattcatgctgaggcccagccaggaaaaaccaaccaaacaaaaacaacagagagtaaaaggagaaattacgaaaatggttctaaatgtctccattctgttactgagattgacgtgctcagtttaggctagatagctgtggaatgttttgtcctagatttgaacagggaaaggcacagaacccttcagaagtgtgtggtcactcattttttccactgccccccaccccgacttctcaaggagataaatatcgaggtcaagttgaaatcagacctgtgacctgtgcctcaatcccaggtcttactgggtcactccagatttataggattggttctgggttttgagtggactgcaggaccatgcttctgtgtaactctagggatgctagtccattggggtccattgaaaggagctccctggagttgcgaagtgaagccctgtatggctttaggctgtgtcctggtatattggcagaaccggaacacccaatgtcagggccagggtgaagtttcctaaggtactgccttagaattttctaagacctttattgaatggcctttattgcctgctttctctttaattcattttttatgggtttttttttttttttgagatggagtctcgctctgttgcccaggctggagtgcagtggcatgatctcaactcactgcaacctctgcctcccaggttcaagcgatcctcctgcctcagccccctagtagctgggattacaggcacgtgccatcacgcccagctaccttttgtatttttagtggagttgaggtttcgccatgttggccaggctagtctcgagctcctgacctcatgtgatccacccgcctcagcctcccaaaatgctgggattacaggcgtgagccaccatgcctggtcctctttaattcatttttatgtattctgtctatcaaacattgacttggatgttatttggggttaatatatgtacattacacgtgagtgatttttttggctgggctttgacttaacctacttctttattttctgattcagagtaacagacataaacctggggaagctggtgcgaggggatgcccatgaatgttttgtttcacctgttgccaaagctgtaattgaacttcttgaaaaatcaggtaggatgctccttgagaaatgccgctgatttctatttattggtatttacattatttttaataaggatttgtttggggaagaattaaaaatttttttaaattattattctgatatccttttaggatgtttctagaagattctaattgaacatagaagtgatatttcacgttgactttttttatttttctcatcttttgggagatacagatgaatacctagaaactttttctagtaagaccatcttataaattaaaagagaaattagtagagataaacgattagccctgttttaaacatgctcaatttctctcatgaaacagtcaaaataaccacagtaaaatatgcttccagtttcagcttactaaatctatcaatatgtagccttagataagacttacgttgaagacttaaatgaggccaggcacagcggctcatgcctataatctcagtgctaggcgaggccaaggccagaggatcacttcaggccaggagttcgagaccagcctgggcaaacatactgagaccttgtctctacaaaaaaaatttaaaaattagctgggtatggtggtgtgcacgtgtagtcccagctatgctggaggctcaggcgggaagatcgcttgagcccaggagtttgaggttacagtgagctgtgattgcaccactgcactctagcctgggcaatatagcaagaccctgcctcaaaaaaaaaaaaaaaaaaaaaaagagaagaagaagaagccggtagatgtagtttagggcacaggagcctaggttgggatttattggtgagcagcttgcttttcagtagtcaggacttaatttccattgttgtccccttgacttggcgtttttatgtcagtgaaatagaaatgaatattttctctttcttcattattaagtttaatgagtaaattactaccaagtatttatatatttaagggctttctgagaacataaagattcaactaattgggccggcacagtagctcacacctgtaatcccagcactttgtggagccaagatgggaggattgcttgagcccaggagtttgagaccagcttggggaacatagggagactccatctctaccaaaaaaaattttttttttaattagccaggtgtggtgacttgtgcctgtagtcccggctacttgggaggctgaggtaggagaatggctggagcctgggaggtcaaggcttcagtgagctgtgatcacaccgcagcattccatcctgggcaacaagcaagatcctatctgaaaaaaaaaaaaaaagaaaagaaaaaattcaacgaactaaatctttttctctactccagtttgaatagaaatgaagcaaatgcccctccctacccctgaacatccaacaatcaaagaaaaatttcaaaaatatatggcaaagttttattaaaaggttaacattcaggatatatatgctttttggacagtaatattaagctcaaatctatgaaataatccatatatacagtgctttttcattacgtggattatcaagatgaagattctgagccacttcattagaaagtactcaaagaaaagagtaaattaggctggtgagttatagttacatattgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattctcaccatagtaagtacagaacagtcatttggtaaatctaatatgcattatgaccttttgaaagtaattataattttgatgaaaattattaagaagacccatataaaagcagaggtatcatcttcatggagaagatgcaatatcttaaagatactaattgtctgcaaattttgtagaatttgacagtctgattctgaaatccaaatggaagcataaaggacaaagagagtcaagacaattttgtggaaaaactaggtgggagacattcccagccacacagtgtgaattattatgcacttacagtaattaggataatatggtagacaaacagacgatcggaacagaagaaagtggaaatttatgcatatatggaagcttgagagcaggtaccacagatcagtggggaaaagattaactattaaaggccgggcgtggtggctcatgcctgtaatcccagcactctgggaggctgaggcgggcaaatcacttgagctcaggagtttcagaccagcctggccaatatggtgaaacaccgtctctactaaaaatacaaaaaaattagccgggcgtgtcggcgcaagcctgtaatcccagctactcgggaagctgaggcaggagaatcgcttgaacccgggaggcaggggttgcagtgagccgcgatcgtgccactgcactccagcctgcgcgacagagtgagactccgtctcaaaaaaaaaagctaaaacattaactattaaaaatggtgctgacttaactagttatgtatatgagtctagcataggattactaacctgccactacatataaaaatcacttctatattaaaatacctaaatgtggaaagcaaaactgtaaaacttatagaaaaaaatataggcgtatgcatttaagaggttggcgttggaaggatagcttaagagaccccaaaagcacagattgctaaagaaaaggtatataaatctgactgcatccaaatttttaaaaaccccaaagtttttctttctgaaaagaagttcttaaaaaagtgaaaagacagctatagtgtagaagatatttacaacaaacatttagccaataattagtgtcttataaaagattcctacaaatcagtgagacaaagacaatctgttagaaaaatggacacatgacagaccactaacaggtgaggaacccgaggtttaaaagacacgtgaaaagctgtctggtttcctgctgtttttgctcaccagtcatattggcagtaggtaaaaagtgccagttagccatattgacaaatgtctggagctatgggaattcatatattgctggcgggagtttaaatttgaaataggcatttcggaaagcagtttaatggagtttgagctactctttgacccaggaatttcactctaaatatatatgatatggccaggcatgatagctcacccctgtaattccagcactttgggaggctgaggcaggcagaccacctgaggttggggtttcaagaccagcccgaccaacatggagaaaccccatctctactaaaaatataaaattagctggatgtggtggcacatgcctgtaatcccagctattcaggaggctgaggcaggagaattgcttgaacccgggaggcagaggttgcggtgagccgagatcacaccattgtactccagcctgggcaacaagaacgaaactccgtctcaaaaaaataataataaaaagtgtatatatatgtgtgtgtgtatatatatatataatagacaaaacttgcccatatatatacaaaggtgtgtttacaaatggtcagagcagcatgtttatagtgcaaaaagttttgtttgtttgtttaagacagaggggcagtggtggttctgtgggtcttggcccctttctgctgtcagggctgagttggctccatgagttggtgaaagcggtatctagccaggttcaagggagacaggggcaggatttcgccttcactgatgggcaggccagcggtcccctgtggaacggtgactattgaatattgagaggacagtatccctccctgagcatcttctggagcttgatgaccactagggaatgtatctgagtcacgcgcaccaaatgtgttaccggtggcagctattcgagttatcccgagttcgtgctggtgtatccgtacagttctgcagcaacttcagctcttgcctcctcggaagaaagaattggactgagggccataaggcagaaggagagactgaggcaagtttcagagcaggacggaaagtctagcaaaaagctctagaacagtaaggaaaggaaagaaggaaagtataacttggaagagagccaagcaggcgacttgaaaaaccaagtgcactgcaacaagtatttaaacagtgatctaaatgcccatcagggtgaaaggataaatcagtatagttgcatgtagagtatgcatagtcatagttcataaaacaatgatatacaagcagtgaaaattaataaactagagctgtagatagcaacatgttttcttgttttgttttttgtttgtttgtttttttgagacgaagtctccctctatcccccaggctgcagtgcagtggcgcgaactcggctcactgcaacctctgtctcctgggttcaagtgattcttctgcctcagcctcctgagtagctgggactacaggtgtgcgccaccatgcccagctaatttttgtatttttagtagagacagggtttcaccatgttggccaggctggtctggaactcctgacctcaggtgatccgcccacctcgacctcccaaaatgctgagattacaggcatgagctaccgcgcccgggctggaagaattttttaaaacactgttcagtgaacaaaaacccaagttgcagaaggatgtatttcatacaacaccatttatatgtgtctgaaagcaacacaacatatatatatatatgtaatctaatacatacatacatataatatgtattacatataatccttatatatatatagaatcttaatatatatatttaggtcaggacatttagatcactgtttaatatatatattaggattatatataatatatattatattattatgtattaattatataatccttatatatatattaggattccatgcaaatgaagtaaaaatataaagaaataatgcaaactacgaaccaaatccgaaaagcatttattgaggcaaggatgtggatatagatggaaaggaaacctagacaccttcatgccttttttcttaaactgggcaataggtgttgtctaggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaataaaccgtgccctgcactgaacagctgtggtgaagagagaaaataccttccttggcaattgaatgttttcgcagctgtcacagatacttttgctagttgtatctatatttttgaaaaacaaagacatttttcaaagtacttttttattacgggaataaatcaccttgtctctgtactttgggatgaatctcatctgaactttgagaacgattaagtggcttcactttctggagaatctggtcattgggtaacattcttgttttcatatggaccagaaggttctctttcatagttgatgttgcacacacgtttttttccctaagtccttggtatttatagtggcaccattgcgaatgttagaggctatcaactttcattcttattattgcttcatctttgtagccaaaaatatgggaagaaatgttcatagccccgccccatacttgtccccctctacctggcctacctacctacgtcaggctcctgtcccaccacaaatgacagcctgtgtctttcatgttagcagctagtctttcactagccacatacttccccgtaacccatatgcctccctgtgtctgcctgacgtttgaattgtcactattctgttgttgtatttttacaagaagaatgtatggggcagaaaacccttgccattcatttcctgagtaggaattctagccttccttggagtcgtggtaatatggagacatggtaatatgtggattgtaccactcaatggctgtctggaggccacagtggtgcaaaaagccacctaggcatgggttagtgtcctggggcacccaatcaggacaggacacctggcacacccttggaaaagcttcactgtgaaaaacactggaagtaaaaattttaacaacagatagggatttttttccccttgagacagaggctcactctgttacccaggctggagtgcagtggcgcgatctcggctcactaaagcctctgcctcatgggttcaagagattctcatgcctcagccacctgagtagctgggattacaggcgagcaccaccatgcctggctaatttttatatttttagtagagatggagtttcgccatgttggccaggctggtctcgaactcctgacctcaagtgatccacccacatggccctctcaaagtgctggaattagaggcctgagtcactgtgcctggcccacatggggatttttgttgcccagcttaatcaaccaagaataaaagtgcattttaagattataatctatttaacttctccttattggcaatggtaaaagagttaaggaaaaaagagaataagcttaggattatggctactaagtagaaggacgttatctttgacgggcatttctgttgtgcttatttgtacctgacatggaacaagacccccccatcccctcaacacatacctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggagatccctgatgggccagttactactttcaggctctgtaggtttaaagaatggttatatccagttagttacaaatagaaatcgatcctttctctgtccgtctgtctaaacggaaggatattctgtggacgctgattaggtataaaatctccacggagcctgagcatgaagaattgaccttcttagggttccacagaaaccagaatagacttctgtgtttggtagctttgtaacttacgcccgttgaggtgtacggttgaaaattgagaataaatttcctgttctgtttctgagcatcttttccaggcttggagatgcgttgagcatttccacggagaccctagaggtggggaggggaagaacgcctgggcatttgtccaaattagccatatgctgtggagtgtcacatgtcaggaagccaaggcactggagctagtgtttttgggcagggctagggaaccccccgcctttcctccacccaaacgcaggcccccacacccagcgtcctgggccctgcaggggaatgacactgttggtttcactctcaggaatgagcctagatttggaggtaacctcttcctgaccccgatgatttcactctgatgccaaaaccagtctgaagtgggtgtggttttgcatttggtgtttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaaaaaatataggtctttcacctttgaaggatcaaagtgtctagggttttttgtggttttttttttttttttttgaacaaagctgaactattacaaagtccttttcagtttaaatttagtgcatggcatggctcatgaaagacttttaaaagtgaattggaaaattctaaatgtacttgtattatacatgtgaaaggatgacttcttaaaaaaagaataatgtctgtcccaaacgggagaaggaaggaactctagcttttaaactgcactacattagtgagttacatgacaattctccttttaacaggatggaatgcacttaaagcagtaatgtgctatggtgacagtaatgacagacaatgttaattgacagaatggctactctgaaccaggcactgtcttgtactcctgttatctcagtggtcttcacacttattctgttaggcaggactgtcatcctccccacattacagatgaggaaactgactgaggcttagagaggagactttgcaaagatcatgtgattaaaaaatggtagaggtggcaaaacagcctgtgtttttaacactgtcccatgtcagctcttattccagatcatcacataaagtctaatctctaatcttgaaaaccgaaaagcacctgccacctcagataagagagaccaagaccctagacattcgacttgtgttgaattcactcttattttgttttgatgtttgtaatcccagagccatacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatctcccatttgcttttctgcactatcagcagagtctggcttccttttccaccccctctccaatgtgaatgctttttaaggtcgtggaattagaatttaaaaaaaaaatttttttgagacagagttttgctcttctcgcccaggctggagtgcaatggtgcaatctcagctcaccgcagtctccgcctcccaggttcaaatgattctcctgcctcagcctcctgagtagctgggattacaagcatgcgccaccacgcccagctaattttgtatttttagtagggacagagtttctccatgttggtcaggctggtctcgaactcctgacctcaggtgatccacccacctcggcctcccaaagtgcagggattacaggcatgagccaccgcgcctggccagtattagaatcttttaatgggaacgtcttaaacataacctataacaatgaagcaccttataagtgtgtggagatttccttttcatggcttttcatatatgcctcgcactcacccagcaaccctgcaaactggatgttatactcaccagagagccttgaccctgattgtcactggcaaggagcagtgtctggacttgaacgcaggtcgcaggactccactcatggtgctctccccactgcacctcaattcctcacttttcaaaggaggcagcggaagcctggagagtttctcaaaggaaacggaatgcagaaatctgtctgtgtgcaatgtgaggctcagaactgaaaaccataaatgtcaggaaatgcaaagcagaattttcccctgcaacggcagtttgcatgaatatgaagacgctgtatggatgaaagtttgtggctgcagcatgagcataaatcctcggggctgctgttcgtctaggagcctgacttgcctggtgttgccctgagaactgcaacttgagcatttccttaattttgtactaaaggaaccaaaatgaggtattttggttctaagtctttgtcatgtgaaggaagcttcctgttaccaccccccatctacatacacattctctttcttagccccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatggggaaactccatctctactaaaaatacaaaaattagctgggtgtggtggcatgcgcctgtaatcctagctactcaggaggctgagacaggagaatcgttgaacccaggaggcagaggttgcagcgagctgagattgcaccactgcactccagcctgggccacagagtgagattccatctcaaaaaaaaatagatatatatatattttttatattatattatatattatatatttatatttttatatatataaatgaataaacaaggcatctgcttatgaaacagtctgcctgaatgaaatctccatttgcaggcaacacagtctacagtaatggcaggactgtattaggcatggttcctaatgcccatttctgtagcaaagtcaccagtagttcctaattgccaaaagtgagtcaccggtagttcctaattgccaaaagtgtattttttgcttttatcttgcttgaccacagctgtcatataaacctgttggccacacccttttcccttagcctgaatgaaaatgccccttcctgcccttcgtagctcctgagccaccaggacatggtggtctccatcatctgttcgttatctctaaccatttaagattagtgctccccaaggatgtctgttaacctgctttccttcccattctgccagtttcccctggggaatccacacttctggttttaaccatcacctaaatgctgtgtgtcccgacccgcatccgcatgctcccaggccattctcagttccagacccgggcccccagcttcctgcagacgcctcctccaggagatctcagtatcttgcttttcctcctaccccttctaaggcattctcaatccagcttccagaggaatcttcctaaaacacatctgactgtgtgagccacatactgtagcccaacctgacagcttcttttctatattaagaaaaagtgcggccgggcgcggtggctcacgcctgtaatcccagctctttgggaggctgaggcgggcagatcacgaggtcaggagatcgagaccatcctggataacatggtgaaaccctgtctctactgaaaatacaaaaaattagccgggcatggtggcaggtgcctgtagtcccagctactcgggaggctgaggcaggagaatggcatgaacccaggaggcggagcttgcagtgagccgggatcgcgccactgcactccagcctggacgacagagtgagactcgtctcaaaaaaaaaaaagaaaagaaaagaaaaagtgcacacattttgacatctgagaaaagtgatgtttttcttagaaaagtgacatctaactctttatagaaactttgccacaaggtagtctaggagtccccttactacctaagattttcatggacatgccctgtctgatcataaagcatgtggcacagtggctcacgcctgtaatcccaacactttggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaactactgcacccccacacgctccctgttaagtgtctgcatatctgtgtcttactgttgtttaaaattcacttgtctgcctggggagtggggtggtttgctttaagctgctccactcaagtctcagcagagaaagcaataatttgttatgagatagagttttaagccaagctttggccagggtctctcccatttgggaggaggaaaataggaacaagtgagatgataattttccttgaattttagctcattaaaatcttcccttgtcctgggcaggctatttactgatttaagcatctagcacttttcctttccagaaagaattaacatctatgatgcaatcattgctaagggaggaggtttttgtgttttctctgtggaattagctgttctccagttgcagatgagcacagcccactttagagttgtgtgtaggtatggagttgaggggtcggaatgagatttccaagatttataggtaatgaaaagaacaggttgtatcaaagacaccacgtgtaggaaactaactgttcttaggggacttgtgtgaacctgtgatccttggctttctccaaaatgaacatttcagccttgttcatattaacctcctttttacagttgttttaccgtgttctggttttgctgctattctgcctgaaaatctagcaaaatggcgtttcttatctgcagaactgcgacaaagcttaaacatttgtatttctcttgaggattactgtggttgaatttttgacagtactatatataaatgaagaaataaaattttttatacagatgtttaaaatcctctttccactagaacatttctttctccctaaatatactattacctggaactctagctgtttttcagatctgtagagatcataggtggcttaagggactagattgctggtgatattggctgcaaaattttttttttttttttttttttttttttttttgagacagagtcttgctccatcgcccaggctggagtgcagtggtgcaatcttggcttcactgcaacctctgcctcccaggttcaagtgattctcatttggctgcaaagttcttagtgaggtttagtggtattttggccctgtggcacagaagaatggttatttagcaaatgtgttttgcttttgattttgttttgtttttgagacagggtcttgccctgttgcccaggctggagtgaagtggctcgatcacagctcactgcagccatgacctcctgggctcaagcgatccttccacctcaacctcccaagtagctaggaccacaggcatgcctcaccacacctggctaatttttattttattttatttttgtagagacagggccttactatgttgcccaagctgttctcaaacttttgggctcaagcagtcttcccaccctggcctcccaaagtgctgggattacccagcatggcagcatgagccaacaggtctggcctcggcaaaggttttagtagggctttctcttttcttttgaagatgattaatacagtagattcatacagccagaagctgaaaagcagggaatactgtttggcttattaatggataatcaatcagtgttaatacacttttccctatttacatggtcaaattgatcaaatatttccaaggtattagcttttaaaagttgactttgtcagctctatgaaaagacatgcatttacatttttatcgtgctcctcctctgtcaggggacttggatctgtccttgatcttggcttttctgttcataaaccaggtaggactgtcatgggtttgctcccattaccatctcttgtcccaagatttctaaaaggcatcacctgatgcacccttttgcccaaatagtgttaaaagtcctcaggctgaggagctgtcctggttcttctacaggatctttaatgatcagcctgtctaagctgagaatggataagggtgtccccaacacgtttatttggtggtttggtgggggtagtgacactggggatgcttttgtgtgttgtaatctgcccctctgtctgtttgaccccagagactctgtggttagttgcaggacatcaaaatacgcaggaaagacagtgggggaagagaccatcagtcgccctcttgctgcctaggttcactagaatctctaagactgaattcactaggagacacaggacataccgtagagctgtttatgtcttgagagccccagtttcctagtctgttaaatgagcatagtaacaccaatctcactcctttggaatattcaatggtgtaatacttacaacatctagctgacctgtacaattatagctattctcttctgcaagtctaatattcctattcacccctccctctgcatagggatccagtttgaaatcatcagttgctcagtagggcctggggagctagctggtcattctttggttaaagtcaaagccaacctctttgcctacctttttgtcttaatgtcaacttcctaccagacatgttcctcccgcactggatgatcaaaatgcaaataggatggacacgatcaatgcattttgttggagtggttgcattctttctactttcttagggcaaaaaaatgaatggttggacaagagactaaccaaggcctcaaagaaagtgaaattctttctcaagctcctgaaagtcctttcatgggtatagtaacagttctataggggtctcattgtgatggtgccattatacaggccagcaagccccctgtgtgagccagacctcatggccttagcccttgttttcctctttttttttttttttttttttgagacagggtctcgctctgttgttggagtgcagtggtgtgatctcggctcactgcaacctctgcctcctgggttcaagtgattctcgtgctgtagcctcctgagtagctgagattacaggcccccaccagcacgcctggctaatttttgtatttttagtagagacagggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctgggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcaggtaaatgtcttcacattggtgttgagccactgattaggtcagatagttcaaagaaatgttaaccttttcctaagaggttatgtttctgaaatgttagcagtcgtcaacattaatatatagggtaggaaacttagactgtgggctacctgatagaaccatgctgttgagcaaagagagaccaagatggcggttgaggtgtctgctcccacagtgaagtgccccctactggcctctagcagtcaggtcagttgtgacctcaagtagatgatttgtatgtgtgtgaggtaaactagaaatagcggttttcacagtttcttaaaaattagtaaaaccctttcttccaaagaaatcttcgtggaatctcactatgtaaaagcagatgagcgccggattgttgggagggatgggaataggatcagcctgtgtgtctccctgatttcctcttgcattgacccatgaagcacatccttggagccccagagtcatctcagaacagtatgaaaatcaccactagatgcagaaactgttgtaggattggtcctgctatttgatggcattttgccaaggtatccaggaatactcaagaccacaccaggcccactttgggggcagcccaagcagtgcccgcaacagggcagccagcagccccgggtccagcaggagccggcccagagtgggttcctttttccagttcgtagaaggactgaggctaagaaagccttggagcacacccaggccctcagcaagtccctgagtagcacaggtgagccagagacgatggcacagggaggcagaggagagcccctcttcctgattccttctggctttggcctccaaatgtttgtgtggaagagaggactgtgctgagctgggctggaggacaggggcagcttttatccctaaagctgggcagaacatgcaccaaggttggcagcctctgctctccttctcctccaccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctctttttaacaaacagaaagcatgtactaaataacattttaaaaatatgtgtaatttattcatataactttttttcccctgaaaaaaaaaaaaaacaaagcctaacctattaatagtggacagggcttcctctgttcagcatcccagtcagattaggaaaatcagttccaacatttgtttcttgtaaatgaatgctgctttgctgtaatatttacttgctgtgttttattaaagttttcatgtaggacagttttggcagtcatggctggagataggagtctactttgatgttctggaatctctttgagctctgtggttatatgacagtgacatatattttgttagtgaaagtgctttatttttaataaggtttccttttaggacccttatttttgaaaaaaagtattccctgaaatattagatatcaatgtaatgattctctgggggaaaaaaagaccaaggcgttacagatgttcctcgactgaccatggggttatgcacagataaacccatcagaagttgaaaatatcattagtaaaaaatgggcatttgtagccaggatgggatgtgaaaacagaaaacaacgtccaaaaatgctggcagcacagtacgctgtagagtattggttgtttggcctcgtgattgcatggctgaccggaaaccacgatttgctgtcactgctgcccagcgcctcaagacagccttgttctttgtatagctggcctgggaaaagatcaaaatttaaagcacagtttctactgaatgcatgtccctttcccaccatcataaagtggaaaaatagtaagtgaaaaggttgtaaatcagggatggtctgtgtatttcaaaatgattctataagtagaatttatttgaaatttatctggcccaactgtaatagttttcttgttggtttttgaatgcccagtgtccagaatagtacctgacgcttagtaaccgctctgtgaaattttttttttttttttggagacagagtcttgctctgtcaccctggctttagtgcagtgggtgtgatcttggctcactgcaacctccaccttctgggttcaggtgattctcctacctcagcctcccaagtagctaggattacaggtccctgtcaccacgcctggccaatttttttttttttttgtatttttagtagaagtgtggatgcaccatgtttgccaggttggtttcgaactcctgacctcaagtgatccacccacctcggcctcccagagtgctaggattacgggcatgagccactgggcctggctaactctgtgaatattgagtgtttgacaagttaataagcatgaatcaaaattctactctgcttgtagttttaagttagtggcatgtttagaaacatttccttgaatttgtctcccacttaaagatggggctgatggccaggcacagtggctcacgcctgtaatcctaacactttgggaggccgaggcaggtggatcacctgaggtcgggagtttgagacctagcctggccaacatggtgaaactcttgtctctattaaaaatacaaaaaaattagctgggcttggtggcaggtgcctgtaataccagctactcgggaagctgaggcaggagaatggcttgaacccaggaggtggaggttgcagtgagccgagattgcaccattgcactccagcctggatgacaagagcttttttttttttctcaaaaaaaaagaaaagaaaaaaaaatgggctcaactaggcagtcattgagataaagatgaggaatgctatgttgatgaaacagatgaacagtttcggggtggtgctacccataatagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaaatcaaacccaagaaaggaagaagtccaatgaaattctgaacatgtaagaaaagtcagctttagagaaattggacatccgtgtaattttcattatgccaaagcaattgatataaaattaggatctttgcttgtgactcttgaactttagtaattccaaaatccattgtacctatcactgttttcttttatttattttttcctgtaaattctggatattctagatctatccctgaagtatattgccagttttccatttcaaattttaattagttctcaatacaatgtatttaatattttgctttttttaaaaaaagtaaaggttcatgtcatttagaatatgcagcactgtataaatttccttgttaatttggtttcagtggtccaaattaagttattactaatagcttattagtatcagtttactaatattttaatttttttaatcatgtcttacattgcattcttttaaaaactagtgatatgctgtcatttgacagtaagaattcaaataatttaaactaggattgcaactctcaagaacactgtcacaaaaattttaccaaatgatatgtattagtccattctcacactgctataaagaaatacctgagactgggtaatttataaagaaaagaagtttaattgtctcacacttccacggactgtacaggtagtatgatgctggcatttgcttggaaggccttctggaaggcctcaggaaacttacaattatagtagaaggggaaggggaatcacatatatcttacatggccagagcaggagcaagagagagggagggcgtattagtccattttcgcactgctgataaagacatacacgagacggggaagaaaaagaggtttaattggacttacagttccacatggctggggaggcctcaaaatcatggcgggaggtgaaaagcacttcttacatggcagcagcaagagaaaatcaggaagatgcaaaagcggaaacccctgataaaaccatctgatctcatgagacgtatttactaccatgagaagagtatggggaaaaccacccccatgattcaaattatctcccactgggtccctcctacaacacgtgggaattatgggagtacaattcaagatgagatttgggtggggacacagccaaaccatatcagaggaggaggtgcatactacatacttttaaaaaccagatctcaggataactcactcactatcatgagaacagcaccaatgggatggcgctaagcctttcatgaagggccacccccatgatcctgtcacctcccaccaggccccacccccaacactggggattacaattgaacatgagatttggtggagacacagaaccaaaccatatcatgatactcattttatttattgcattttactttatatcctacaaagtcaatatatttaactgaaaaactggctaccagtgtttttgtttttttttttcaagttctacctgtactgatttctaatttttagccattcctgattttaaaacctcgcatacattttggggataatttgttctcctagatggcgagaaaatatttaagtctgtgggcttggagaatgcttttttgataagaaggatgcccttggccagactgcatagaagctgagatgtttccgcagagccgagatggcatgaaggctgaagaattttcctgcatccctcccactgcagtgattgttctggcaaagttcccagggtggtctctgcactgctcatattagtgaaagggtggttctgatttctgaggaaggcatgataacactttggccttaaattttctttttgcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtctgattctgagttgccagtcttaattgcttgagattctctggattcagaacttatttttattttttttatttttattttttgagacagagtctcgctctgtcatccaggcaggaatgcagtggcgcaactgcaggcccactgcatcctgagctcaagcgatcctcctgccccagcccccaggtagctgggactacagacatatgccaccatgcccaactaatttttttttttgaggcagagtctcgctccctcccccaggctggagtgcagtggcatgagctcggctcactgcaagctccgcctcccgggttcacgccattctcctgcttcagcctcccgagtatctgggactaaaggcgcccgccaccacgcccggctagtttttttttttgtatttttagtagagacggggtttcaccgtgttagccaggatggtctcgatctcctgacctggtcatccgcccgactcggcctcccaaagtgctgggattacaggcgtgagccaccgcgcccagtcccaactgatttttgtaccttttctagagacgaggtttcaccaggttgctcaggctgctctcgaactcctggacttaagcaatcctcctgccttggcctctgaaagtgctgggattacaggtgtgagctactgcgcccagcctgaatgcagtcttaaaactgaattagaaaatctgagtgcaggctagagttatatataattaagagagtgtgggttttaagttgtgtcttaaaattgtgttgtttttggtcgagtctggtggctcacacttgtaatcccagcactttggggggcctaagtgggctgattgcttgagctcacgagttcgagaccagcctgggcaacatagtgaaactctgcctctacaaaaaatacaaaaattaagcccaggtgctgtggctcatgcctgtaatcctagcactttgggaggccaaggctggtggatcatctgaggtcaggagtttgagaccagcctggccgtggtgaaaccctgcctctactaaaaaaatacaaaaactaaccaggcgtggtggcacatgcctgtagtcccagctacatgggaggcagaggcagaagagtcccttgaacccaggaggcggaggctgcagtgagccaagatcgcaccactgcactccagcctgggcgacagagcaacagtccgtctcaaaaacaaaaaacaaaaattagccaggcattgtggcatgcgcctgtagtcccagctacttgggaggctgaggtgggaagatggcttgagcctgggaggcgggggttacagggagctgagatggtgccactgtactccagcctgggtgatcgggccagaccttatctcaaaaaaaagtgtttttaattacttgtaattttaattgcttgtaattaaaaaacagtaattaaaaggaccaaaagttaattttgcaggtagtaaaccttagcctactgtacgtaaaaatcagaaggccaaggcaggaggattgcctgagtccaggagctcaagaccagcttgggcaacatagtgagaccccgtctctataaaacaacttaacaatgtgccaggtgtggtggcacacccttgcaatcccaactactcaggaggctgaggtggacggattgcttgagcctgggaggtcaaggctgcaatgatcgtgatcacatcactgcactccagcctgggcaacagagcaagaccctctgtaaataataacagtaataatcagaaagcaacactgtatgtgaataaagtcaccttacctagctgccggtggacagcctttggtgtttcaaggacttagtttttatgcgttcctgctttcgatatttgttgactgtgagctttgggcttatccagggtccatgaagaagaaatggctcttccttatctcaggcttttgttattttggggtgttttaaattcctctcctgtggttactcaatccgaccctacttgcctctctcttccacaaatttctcaaatgtcattcatggtacccttttaactcttacggacttacttgtttttaacatatcttttattcactttgaatggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagccaaaagattacacattgctgaaaactttagatgtatcaggaatcatatagcttttcaaaataaaatatccacacttttgctaagttctatgctatgcaagtgactgaactataccaggacttatcttgtaaacttggaagtgaaatattcttcactcgcaagggtattttgtgattaaattctggaaatatgcatttataagttgataccagctcctggaatgtaactttttcttttttctttttttcttttttagattttttgagatgaagtctcactctgttgcccagggtggagtgcagtggcacaatcttggctcactgcagcctctgggtcccgaggtcaagcaattcgctggcctcagcctctgagtaggtgggactacaggcatctgccaccacagctggctaacttttttttgtatttttagtagagacagggtttcaccttgttggccaggctggtcttgaactcctgacctcaagtgatccacccacctcggcctcccaaagtgctgggattacaggcgtgagccaccgcacccggatgctttttctcatttctccatcgcttaaagatagaggattgagagaggcccgtttgtggacacgatcttaagtacagatctctagtggttaaaacgaaacacaacaattctctctcatcctctagactcttggcttttgcctaaatatgattcataaagctgaagtgttgctaatctttaaataacacccaagggatatgattatatgattacccaacaccctaatacagtttaagaatagagtgatccaaagaaggagaaaatagtgtcttcaaaaatgttgctattagaaatatttcttttctctaagggaggatgcaggctaaagtatttagcatgtgtgtttacttttataaattttctaagtgatgaaggaaggaaggtagaatctttttttttttttttttttttttttttcagatagagtttcactcttgttgcccaggctggagtgagtggtgtgatctcggctcaccgcaatctccgcctcccaggttcaagcgattctctgcttcagcctccctagtagctgggatcacaggtgtgcaccaccacgcccagctaattttttttttttttttttttttttttttttttggtatttttagtagagatggggttgcaccatgttggccaggctggtctcaaactcctgacctcaggtgatccaccctactcggcctcctagagtcctgggattacaggcgtgagccactatgccctgccagaagtagaattcttatcaacatctttctaggttgataatcaggtaatccctaaagttaataccctaaaatgcaattttttagttttgatggaaaattgattctatcccttttttttttttttttttttttttttttttttttttttttttgaggtggagttttgctcttgttgcccaggctggagagcaatggcacgatctcagctcactgcaacctcggcctcccggttcaagcgattctcctgcctcagcctcctgagtagctgggattacaggcatgtgccaccacgcctggctaattttgtatttttagtagagatggggtttctccatgttggtcaggctgttctcaaacccccgacctcagatgatccacccggcttggcctcccaaattgctgggattacaggcgtgagccaccatgcctggccggttctataacttctatgatagagaatttttaaattatcaaaaaagcctgatctttcatgtaacactttgaccagtcttaccctgtgagtgttttcatctgccttctcacgctttgcatccacaagtgaaagtgcttctatttttctatgtattgtacagtaaagattttagagctttctaggccaggcatggtggctcgcacctataaccccagcactttgggaggccgaggtgggcagatcactgaggccaggagtttgagaccagcctggccaacatggtgaaaccctgtgtctactaaaaatacaaaaattagccgggagtgttggcaggtgccgtaatcccagctgctaataaggtggaggttgcggtgagctgagatcgtgccattgcactccagcctgggtgacagagagagactctatctcaaaaataaaaaaaaaaaatttttttagatccttctaataagatgaagcccactgtgtcaaaaaaaaatctaaaggttaggatatgaagtcattctgacagattatgctgtggaagaatatatatccctgttcctttcttctgagccttactttcatgttaatagtttaaactacatactatatgccaagaactttatataccttatcatatttcattttcacaaaattttaggaggttgatattactcacattaattaacaggcccaacatcacaatttctagcaagaggaagaggtatgcttttaatgcaagtctgactctgaattctgtggcctaatctgcagtctatgttgcatccacatgttttaaatgttcgctatgaattctcttgagctattatttctatctctaattatgccataatttaaaaatcagaatacttgggctcgtgtgaagagatggtgtgcctagatgtttcttcctggctcagtgtgagatatgattttgaaagcacatgatgtgcttcattacattttttaaatccatttatcccaggttaatagcttagatggcctttttttttttttttttttgagatggaatcttgctatgtcgcccaggttgcagtgcagtggcgtgatcttggctcactgcaacctccaccttccagcttcaagcgattctcctgcctcagcctcccaagtagctgggactacgggtacacgccaccatgtccagctgatttttatatttttagtagagatggggttttgccatgttggccaggctggtcttgaactgacctcaggtgatccacctgcctcggcctcccaaagtgctgggattacaggtgtgagccactgcacccggccagatggccatttctctaatgtaaaatgtgaagcaggcccaatggagggccccaagcctgtgccagaggtgaccagtctgcagccgtgccccgacatcctaacttccttggtgaaaaatgagaccactattcagtgtgctagctgtttacaaggagcaattggttagaaatgacagtgtactgaaagtcttttttttccctccaattttttacagggaaggttgggtgtggctctccaagaatacattttggtggactcattgaggaagatgatgtgattctccttgctgcagctctgcgaattcaggtttgttcaacatagctgtctgagaatcttgagtttggaagtttgattaatagttgctaacattttgcaagtggtttctgtttaccaggtacagtgttaaacacttcacacacagtgttaggcccatttgataagtgaagaaatggtgattttgaaaaatgaagtgagttgcctatgatcacatggcagtgtggggcagggacccatcctggggactgtgtatgttatcttgtgctgtgtaataaattatcccaaaatttagcaactgaagcaacaaggcatttattatctcacagtttcttcaagtcagagatttggtagtagattagcagattaggtggtatgttagtccattcttgcattgctataaagaaataccagctactcaggaggctaaagcaggaggatcgcttgaacccaggagacagaggttgtggtgagctgagattgcaccactgaactccaacctgggtgacagagggagactgaaaaaaaaaaaaaagaaatacctgagactggttaacttagaaagaaaacagatttaattggctcacggttcttttttttccccttgggacagagtctcactttgtcacccaggctggagtgcagtggtgcgatcttggctcactgcaacctccacctcctgggtttaagagattctcatgcctcagcctcctgagtagccgggactgcaggcacacaccaccacgcctggctaattttttgtatttttagtagagacagggtttcaccatgtcggccaggctggtctcaaactcctggcctcatgtgatccacccgccttggcctcccaaagtgctgggattacaggcatgagccaccgcgcctgacctggctcacagttctgcaggccttacaggaagcataacacaggcatctgcttctggagaggcctcaccaagcttccaagaatggcagaaagtgaagggaaagcaggcatctcacaaggcgggaacaggagcagagagtgagggatggtgctatatacttttaaatgaccagatctcatgagaactcattcactatcacaaggacgctaccgagggagatgatgctaaaccatcatgagaaactagcccctgtgatcccatcaccctccaccaggccccacctctaacactggggattacatttcaagatgggatttgggcagggacacacatccaaactatatcaaattgtttaggctcaggatctctcatgcatttgaagtgaagatgtcagctggggctgcagtcatctgaggcattaactggggctggaggatctgtttccaagatggcatactcacatggctgtgggcatgtgtatttcattcctcactggccatcagcaggatgccttggttcctcatcatgtccacctctctgtagggctgctcacagtgtggcagctaacttcccccagtgtgagcaatccaagggaggcaaccaggaggagtctgcagtgtggatgacctgggctctaacctcatgtgccgccacttccttttatcctgtttgttagaagtagatcactaagtccagttcacattcaagagaaggagaattgtcctcacttcttcaagacaggagtattaaagtatttggaggcattttttcaaaccaccaccacctgtgtgacctaaaggcgaaggtcatcagtgttccaccatataagctgagtgttctcatggtgctggagcctgcagcagtggtggcctctggcagtgacatttagttcatttctttcttatgtacagggtaatacacaattgaaactctttacctcaaaatgggtcattagacatttttgtaaggattataagttacatttccatcaaagccaaattttatttttatttatttttatttcatttacttataatttatatgcatacataacactactcagtagttcaatttgcttgctcttttataccaactatggaaggatggtatttggaagctgggcatccaagctgatcattcacgcagtcctatattttcttcatttttcttttctaaattggatgacgaacctattcagtataagtttatccatgtacatgatgtcttttgtgaacacttaatctatttatttatttatttatttatttgagacggggtctcactgtgtcacccaggctggaatgcagtggcacgatctcagctcactgcagcctccacctcccaggttcaagtgattctcctgcctcagcctcctgggtagctgggattacaggcacatgccaccacacccagataatttttttttttttttttttttttttttttgagacagagtttagctcttgttgcccaggctagagtgtaatgtcgcaaactcggctcactgcaacctccatctcccgggctcaagtgattctcccgcctcagcctcctgagtagttgggattacaggcacatgccaccaccacgcccggctaattttttgtattttttgagatggagttttgctcttgttgcccaggctggggtgcaatggcacgatctcagctcactgcaacctccacctcccgggttcaagtgattctcctgcctcagcctcccgagtagctgggattacaggcgtgtgccaccacacccagctaattttgtatttttagtagagacggggtttctccatgttggtcaggctggtctcgaactcccgacctcagttgatcccgcctacctcagcctcccaaagaggattacaggcgtgagccactgcacctggcctaatttttgtatttttagtagagacagggtttcaccatgttgcccaggctggtcttgaattcctgacctcaagtgatctgcccacctcggcctcccaaagtgctgggattacaggcatgagccacctcacctggcctatttattcatttatttttaaagagacagaatctcagctaggatgaagtacagtggtgtgatcttgactcactgcagcctcaaacttctgggctcaaacaatcctcccacctcagcctcccgagtagctgggattataggtgcgcatcaccacacctggattttttaatagtgtattttctcacattttcctgtttttctttttaaaatttaacaaaaacaatgaacatagtcagaagttctggcctgtgacttgaaataaccctggatgtacatttttaaaaacattctcagattcattgctgtaagtatgaagagctaatagtctgcaagggaactatagaattaagctggatcatcaagttcatgcatgcatatttaagaaacagagcagcttcttttaatactatcaaactcttcagtgcgatattgaatagttgtatatctaactagtggttttcacgttttcctttttaagaaaaacctacaaacctagttacacgtgaataaaaatattcctaatatcctcctggcttattgtgcgactcgataatcttgttttgtaacatccacaaacaatatttccatggtttaagtgtgtgccctgtcagcttttaccattctaacatgttttcccctctatccctgctgaagaacatggtcagtagtggaaggagatggcttcgtgaacagcagcacaggcggtggagacttcactgcttgaaacttcagcctctctcccctgtgccaaggtaacactggtgttttatttacactgatgtcagctcagcacagtgccttagccctagttagtcatgggggagaagcacaactcatggtactgtggttttgatggtagataagtttctctattcattaaattgccaccctattttctctattgtaaattctccaaaattaaatcataatgaatgtattactgtgttctgtcaattctaagaaggcatatttttttatttcaatgatgttttctatattaaatggcagttttttaatgatgttttaaaattaatttatattaatttaatttcaatgatgtttcctatatttaatggcagtgttttccccccccacccttttttttttttttgagatggagtcttgctctgttgcccaggctagagtgcaatggtgcgatctcggctcactgcaacctctacctcccaggttcaagcgattctcctgcctcagcctcccgggtagctgagattacaggtgcacgccaccacacccagctaatttttgtatttttagtagagatgggggtttcaccattttggccagccggtctcaaactcctgacctcaggtgatctgcccaccttggcctcccaaagtgctgggattacaggcgtgagcgaccacgcctggcctggcagtggtttttcttcttagtggtccatgaagtaatggttttaaatttgacaaaatatggtaatgtaatatttggaatatgcttttcaatgtcagaaatgcccaacacgtatatatccgcctggtgttaagggccatataggtttctactctggggataaaggaccgtccaaaccaaacattattccacgtgggaactgagctcagctttcttcagaacgatctgatagaatagtctgtgctcgtcaaggtggatattttcctcagagtgctctctgatgaggtctgagctacatattctatctataaatttggaaatataaactgtaggtcatagtctcagcttgtggtttagaatgattgggtagggatgatgtctgaatcagacagctgcattttccagcctgatgatgagtcatctgtgtctgtcccactccaaggaattggccccacccccattatccaggtgtgcataatactaggtgtgcatccccaggtaatctcatccagcaacgttggaatgcacacagtgccgaggagataaaatccctctagtaactgacactttatttatttatttatttatttatttattttttcttttttttttttttttttttgagacagagtcttgctctggtcttgaactcttgacctcaggtgttccacctgcctcggcctaccaaagtgctgggattacaagcatgagccaccgcaccggggctgactcattttttacctgataaccagttgctttatagaattgaactccatttccttggacagtcagatgaacaccctggttcagttctacccactaggagggtgtgaccctcctggacatgttttcatccctgcaatagacgaaacatctcagttatgctctctgttcattaattatataagttgcaatgaggaatgttattctttgtaatatcatccctgggcttgtgcaatctgtttcataaaatatcttattttagagttatttttgttgttataagaccttagattttaaaagtaaatcaataatttctacttacaaagtgctaaaaaagattaagatagattccaccaaattgtgtaccaaagtttcaaagtaaattcttcttgttaaataattaaatccttttctcccccaagaagaatttactttgaaatcattgatttctagacccactgggcaaagagaagcaggctgagtagtttataaatcaccccaaaaatcggatgatgtctctgtgactagctagtaaagagaaaaccttacaggtgtttgttttgttttgtttttgagacagagccttgctctgttgcccaggctggagtgcagtggcttcatctctgctcattgtaaccttcacttcctgagttcaagcgaggacatctggctaatttttgtatttttagtagagacagggtttcaccatgtttgccaggctggtcttgaactcctgacctcaagtgatctgccctcctgtgctcccaaagtgctgggcttacaggcatgagccaccatgccaggcctgttttgtttgcttgtttgttttttgagacagtcttattctgttgcccaggctggagtgcagtggtgcaatctcagctcacctcaacctccgcctcccaggttcaagtgattgtcctgcctcggcctcccgagtagctgggactacaggtgccaccaccacacctggctaatttgtttgtatttttagtagagacgggattttgctatgttggccaggctggtctcaaactcatggactcaagtgatcctcccgccttggcctcccaaagtgctgggattacaggcgtgagcctctgcagcctgccaaaagcttacacattgttcaagattaagctcttcaatttaggagattgtgggaagagagagacagaaaaaaactatggccaggaaggcaaaacaaagtaggaggctagaaaggaaaggtcggataggtggaggcctggaaaggaatactcagcggtacttgaggggggtaacctgaactcctagtttctctggtgccctttggagaagtctgggtggaggtgtgtttgctgttgcctcttacccccgggtcaggcccctacaggatcctggaggagagtctagggtggtctgaacactgagggtagattacctgcagtagctacagaaacagtcagggccaaggggctgactaaagtccactgagggggttgatctgcccaccgcaaggaggcagaccacaacaaaaataagtgttctggggtgagtgaaggaatagctgtcctctctgatgcaacctttaagggtagtcccccgccgcgtggtctcccggggttagtcttgctgctgggggaacaggtgtgccttccatctctcactctcagacacatgaagggcctgactgcccagcaaagaaatgactgagcacatgagccccagaggaaagagtccagcattacacatgctggtatccagaccactcctgtaagacgagcagtggtggccagtaaaatagaagagttcagttacgtgcccaatgactctctggagttcctacaatttcctgtctgaacttgggctcagggcactaggtccttttaccgacagttatgtaattaataaaacattttgaaatatgattttagactgtaaatagagagggggaagtgtggacacagataaaacgaaatagcatttccacattttttctttttttttgtacttaatctctaatgtgatagtaatgttcacatttttgaatagccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgtgatctcagctcactgcaaactctgcctcccgggttcaagcgattctcctgcctcagcctcccgagtagctgggattacaggcatgcgccaccatgcccagctaatttttgtatttttagtcgagatggggtttcaccatgttggccaggcttttctcgaactcctgacctcaagtgatccacccaccttggcatcccaaagtgctgggattacaggtgtgagccaccgcacctggccacatcccagattcttaaacatgttggggaagcaggggctgggggagtagcaaaatgcccaggatgagggtggagatcccatcttacacatcttctggcacctctagttccatcaataagtgctaccctggtagttctgagtgtttctaattgtccaagtgcactgatgcagaaaaataatttgaacatagaatagggatgttccacaacttacttgaccaattttctattgatgggcaatcaaagtgttcccaatttttgccattttaaactgctagaattaacaaccttgggcatgtggatttgtgcatctgtttaattatctccttaggaaaaatccccggaagtgagttcaattatttataaccacaaataaagcaaaaatattatccaaaacaggccaagcgcggtggctcacacctgtaatcccagctctttgggaggccgaggcaggtggatcacaaggtcaggagatcgagaccatcctggctaacatggtgaaaccccgtctctactaaaaataccaaaaaattagccaggcgtggtggcaggcacctgtagtcccagctactcaggaggctgaggcaggagaatggcgtgaacctgggaggcggagcttgcggtgagccaagatcacgccactgcactccagcctaggtgacagagcaagactgtctcaaaaaaaaaaaaaaaaaaaaaaaatcacctctttaatgatatagtgatttcttcaaatcctttttccctcctcctgtcccactttcctgtcctcctctttctccttctctttgtgtagcttttcttttttttttttgagatgaagtcacccaggctggagtgcactggtgcgattttggctcgctgcaacctctgccccctgggttcaagcaattcttgtgcctcagcttcccaagtagctgggattccaggcatgcacccccacgcctggctaactgtttttgtatttttatagagacggggtttcgccacattagccaggctggccttgaactcctggcctcaagtggtccgcccgcctcctccttccaaagtgctaggattacaggtgtgagccatcatgcccagcttctgtagcttttttgtaagagggacagacagccagggcctctctgaatccctcagcagttggcattgtaaggaattcatcctttgctccacaccttggttgcctgtggcttcacccttctcccgcaggcttccaggctcactgcagttagattcctgagcccctttccaacctagaaccccaaacttaatgtccccataatcgagtgtgggaaagttcctggctgaggggaggggttggctccacctgcaggcaccctctgggcccacaccctgcaaggagctgcctctggttagattggctccggggtctctgagtttagggcacagtttagtcagggttgttttatggcagtatgcttgatgcatatttgtctgcaattaataaacaaactcttggccattaagaccttgaaaaagcatttgatttgtgaaattggttcctttcttccaggcttcagatgatcttggtaggtgggtttgcaggctttctcaccctgttcagataggaacacttaaggaaaacttggtaggatgtgttgtctgtttatgaaggaagaatcctgcagcagattttcttatccagtccttgtgctttactccattttgggcttgtcaataaaatcagaaatccagatatggatggctctgaccttagcttggaacacaaaactgatacttctaaaacaaagctgtgatgatactgttttcaggttccttacttgtaaacaaagctgggcctccagcctcatgctggagaatgctagctagcacgactgcctggggttacagccaatgcagtccatggccagtagaacatttctccacgctggctttttgctagcattaatatgtataatcaagctgaaattggcctgccatgttgtaaatagaaaagaagactaaagatgaattttcaagaacagattaaacaccaagggatcaacaattctttttctgaaattctaagtttctttacctaacaaagacctttgaaggaacaaaaattaaatggcctgtctcttttttaactgtagtggaaaaaaataaccgtgctggtaagattatgatatatgtatgcatttgtggcacagcttgaagatttttaggaaatagccacactggattctataagggaagaatgaacagccccttctccccaacacaacaaatgatatattttttagggctgtaaactgtcatcagtatctaatcccttaatagctgaatattgatatcagtttagatcacaggcaactattttatcgatagcctaaagtgggcctggcatgacgggttgtgcctataacccaattactctggagactgtgggtggatcacttgaggccaggagttcaagaccagcctgagctgcatagcaagaccccatctttaaaaaatacaaacaaacagcaaaaagcagcactggtttaaagcaacatttgtaatctaaagtgaaaagtcaatttgaaataaaaatcatcttcatatttttacatttgaccaggtcaagcgttagggggaaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatgggtgcctgtaatcccagctactcaagagggtgaggcaagagaattgcttgagcccgggaggtggaggttgcaatgagcagagatcacaccattgcagtccagcctgggcaacagagtgagactccatctcaaaaaaaaaaaaaaaaaaaaaaaagcatcattccattgtcaacccttttttgctgttctgtgccctgaacaggtgatgtgatagcggtgcaaagagggtgagcattgtcctttacctcaacaagtgtgtggcctggtaggcgagacaggcatgtcagaatgcttatcatgaagccatctgaaaaattctagaataatcatataatcaatgctctagatatcagagagggggtacagaaatctgccgggagaagtggaggaatgtaatgaacaaaaatcacagttccatctctatgaactctaagctcccatagaaaaagaaattagagggctgggcgtggtggctcacgcctgtaatcccagcactttgggaggctgaggtgggcggatcacaaggtcaggagtttgagaccagcctggccaacaaggtgaaaccccgtctctactaaaaatacaaaaattagccaggtgtgatgacgtgcctgtagtcccagctactcaggaggccgaggcaggagaattgcttgaacctgggaggcagagattgcagtgagctgagattgtgccactgcactccagcctgggcaacaagagcgaaactccatgtgtctccaaaaaaaaaagagaaaggaagaaagggaggaagagagggagggaggaaggaaggaaggaaggaaggaagggagagagagtaattagattaccttaaggaaagaaggaaggaaggaaggaaggaaaagagagaaagaaagagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgctagcatatccttgggaatgaaaatgtaatccttcatgtgacacagtttaggtaaaccacttagtcctttgcaaacaccaaatgctcagtgcggtacttaaatgacaccatatttgatgccacagtttctttacaggctcttctaagattgtaatgcctgtgggcttttaactgcccttattgatgttgtatccaagaaaacagaaagttgactccaagcagaagtattaatatctttgtataactttcagtcttcacgttgaccccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctgcttcctgcctcagtggcgtttgactttcctgttctggaaacagtctcatccttggcctccttctgagacttcctgtcatgttctgccttcttctccagggtcctcttattttttgtgtttttagagacagggtctcactatattgcccaggctggtctcaaactccctagctcaagcagtccttttaccttggcctcccaaagtgctaggattacaagcatgaaccactgcacacagccgggttctcttattttatactacgccttcttagtttccttttggactctcttcttctgacaactcattacaagcaaatgtgcttaactcttctgtccttatcccttttctcactcggtgcactgtccttgggtgatcttacccattccatgctttaaatggctatagttatgatttccatccatggagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggtaagcttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcaaggagtccctgtacttatagttgctaacaaacaagacttgaggaactcattgtctctttcagaaattgagaaattgttagcaatgggtgaactgagctcatcagctccttggcatttgtagcctacctgtgcaatcataggagatggcctaaaggaaggacttgagaaactacatgatatgatcattaaaagaaaaattttgcggcaacagaaaaagaaaagatgaatatcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatacgcagcatgacaaatctcacatactattatctgaaataaattgaagtttataatttactcatttgaggtggttatgcggtggtttttttgtttttgtttttgtttttgttttgagacagagtctcacttggttgcccaggctggaatgcagtggtgcaatctcggctcactccaatctccgcctcccagtttcaagtgattctcctgcctcagcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcccttgcagactcttttcctgttctctcttggttccaggattttcccatgcctggaacattcttccttttctgtcctctttacccagtttagtcaaggttttttgtcaaggttcttctctaccccacagactccctctgtgtttacggctatctggttcagttggctgtggcgagttgcgggcctttcttgaggtctcaggtcccagcattgagcagagtgcccagcacatagtaggaactcactagaaagtacttgttgactttgttaaaggaatagaagtgtttacccatggaggtctgagtgtcagggaagctaaagagaaaatctgtaggaacttcaagtactgggagtgggggtgagaaagagtagtccaaggcactgctgaaaaaaatcgtcccaggcctcaggtcagaatggggatgggtaccattcatgagccagcaagacccagaaccaggaggccaaattagaggtggtgtacaaggggcatacacaggggaatggctcgggtttagccagcaaattggaaggacattggtgtcccgctggtttagggcatcagctgcgtggcttggaggagagagctacttttattttattttattttattttttgagatggagtctcgctctgtcacccaggctggagtgcaatggtgcaatctcggctcgctgcaacctctgcctcccaggttcaagtgattctcctgcctcagcctcccgagaagctgggattacaggcacctgccaccatgcccagctaatttttatattttaatacagatggggtttcaccatgttggtcaggccggtcttgaactcctgacctcaggtgacccacccacctcggtcttcaaaagtgctaggattacaggcgtgagccaccgcgcccagccaagaagactaccttatgagggtagagtgggccagacacactcaggcaatttgttccttgaagttgagtgcctccagtcttttcttcatctgtatcctcccagctctgagcaccgtgcctgacacttggtggatgtttgttgactgtgtgccaggcacagacaatatgtactggacggaacataataaatcaccataggggaaaatgttagaataaattccagatgggctgaggaattgaaagtgaaaacactatgactggaaggatgggaaggagccggccttgtgaagaatgagggagagcattcagccagtgggaactgctggtgggaaagtcctgaggcaggaaagggtgtggcctgttcagggaactggaggacaccagggtggctggagccccgtgggccagcgggagttgggggggttgaggtagagaagtgtgcaggcgccagctctgtcgagcgattgcaatttgtagccaagaacctggattttatttgaagtgccaaggtcagccattgaagggatcttgacagataacacaatgcagattgagttttattaaaatcaccctgtcttctgtgtgatgaaaggaccaggggcctctcagtagacacgatgaatccaggaggaagactatggaagtagcctagggaaagatgtcagtgacttggcccaggatgggggcagtgaggatggaaaagaggaaaaaacagtttaagatttgtttgctgatgtttgcaggattagatgttgggggttagaaaagaggaggattcaaggacgacatccagggtactggcttgagcaactcagtagactcatttgttgaggcagagaacaggggagtgatggtatgaggtttgaactgtgtggtgtggggtgtggtggagggtggtagtcagaaggagggagtcagtttagaggcctatgaaacatgcaggtggacatcaagtagacggctggaaagaaaaacttacattccagttgtgaaatggccaaagagttcaatagaaacatcgaaaaagaaatattaactaaatgcatattcatcttcaccaataatcaagtaaataaatctacattaaaaccactatcaggccgggcacggtggctcatgcctgtaatcccagcactttgggaggctgaggcgagtggatcacctgaggtcaggagtttgagaccagcctggccaacatggggaaaccctgtctctactaaaaatacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggtgtggtggcaggcgcctatagtcccagctacttgggaggcaggagaatcccttgaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgcggggctgaagcgagaggatcacttgagtccaggaatctgagaccaacctgtgcaacatagtgagactgtgtctctacagaaaaaaaaagaaaaaaaagaaaagaaagagagctcatttaacctagtaactacctcctgaaaatatattactcattagcaattaatttttttaataaaaggaaaagctatttgtgtatattctttataactgtggcctttcttgtaaaagtgaacatttggtagtagcgtatatatccagcctgaaacttttggtacatctaccgtatacagcttctataaactatacaaaagattattatagaaaaagttttgtgaaaaacgaaacttggaagtttgtaggaagatgattctacaaatgataatcgagtgtgctcatgagactggaaggaaaataacagaatgagtagagtcatgagggtaaaatactctatttctccaaagttctgtaatatttcatattattttattgttactgtttattttatgccctgcctcactccaaagtatatttgatatgatactgttttctagataataaaacaatgaataaacgtagtgagtgactataaggagattcattattaaatgcatcagaatgttttgccttaacctgaggatggaagaatttatgatctgagtaattgctcaaaggttctttgttgtcacgtggaaggctttgaccttgattttctgatttaggcattcctatagactcagctcattataaggatatgtaatttgcatgctattttatttattcagtccttaaattccatagttgtttaaaacaaataggaagatgtcttagccgagcacagtggcccaagagctcataaccagcctaggcaacatagcaagacccccatctccacagaaaattcaaaaattagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtcttttatctaaatagttcggttataaatgcaatgaatttttgtcatatcctgtgaattgtccaagttcatggacaactaacttttgtgtggtctcatttttgttttgtgtttttaggctctgtataatcggctggttcctttagtgaatggtgtcagagaattttcagaaattcagcttgctcggctaaaagtaagtttccagttagcaattctttaaaaagaaaatatcgtagaaacgcatcagaaagattgtcaaagcctgaaattttcaacttggtttgattttggttttcagatatccttttgggtattaaactctatagagaccgaacactggagcagagagagcacagtgttggaagcctgaaccctggttctacacgaaagagccaggtggacaaattaattaaccttttttggtctcagtttcttcgtctatgaaatgagaggactgttttgctaatttatgagtactctagtcaactgacaagttagctgggcacaggagcacatacatacctgtagtccgagctactcatgatgctgatgtgagaggtttgcttgagccaaggagttcaaggtttatagtgcaccatgatggcccctgtgaatagccactgcatgccagcctgagcaacacagcaagagcccatctcttaaaaaaaaataacaaattagaatttttggtgagtccttctctttctaaagtgaaatatttttatgaaatttgttaaatttctaggaaattataggataacctttgaaaactcatctatctcatttgtggttttctgttttgttttgttttgttttttgagacagagttttactcttgttgcccaggctggagtgcagtggcatgatcttggctcactgcaacctctgccttcctggttcaagtgattctcctgcctcagcctcccaagtagctgtgattacagacacgcaccaccgcacctggctaatttttgtattttcagtacagatgggatttcaccatgttggccaggctggtctcaaacgcctgacctcaagtgatccatccaccttggcctcccaaagtgctgggattacaggtgtgagctactgcgcccagcctcatctacgtttttgttgcagcaaacactacaattatacttgcgtatgccatcttaattcttaaaacctgtcttatcttttttctgatgccatttgctgcctctggtcttctaatcatattgcttgctactagccctgtttcagagactaaaaaataaccctaaatggtataacttaacaaccttactggttggtattaagtggttttaaaaattcacctcctgcctcttactgaaccaagttcagtgtgttgaattagtgagtaattccatcctcggcagctataacaacatgcagtttctgtttcccagatcttttttatgcttcattaaaaatcactattttgccaggcacagtggctcacgcctgtaatcccagcactttgggaggccgaggcaggcagatcctgaggtcaggagattgagaccatcctggctaacacggtgaaaccccatctctactaaaaatacaaaaaattagccgggcgtggtggcaggcgcctgtagtcccagcttctcgggaggctggggcaggagaatggcgtgaacccaggaggcggagcttgcagtgagccgagatcgtgccattgcactccagcctgggcaacagagcaagactccatctcaaaaaagaaaaaaaaaaaagaaaaatcactattttgtgtgtgtgtgacagtcttgctctgttgctcaggctggagtgcaatggcacgatctcggctcgctgcaacctccgcctcctaggttcaagcagttctgcctcggccttctgagtagctgggattacaggtgcccaccaccatgccagcgaattttttgtatttttagtagagaaggggcttcaccatgttggccaggctggtctcgaactcctgacctcaggtgatccacctgcttcagcctcccaaagtgctgggattacaggcatgagccaccacacccagccaaaaatcactttcttaagatgttttatttacacaaaataaataggaagatttcttggcttggtgtggtggctcacccctgtaatctcagcactttgggaggccaagacaagaggattgcttgagcccaggagttcatgaccagcccaggcaacatagcaagacccccgtctctacaaaaaatttaaaaattggctgggcattaaaagttttaatttttttttttctcctccataaattaggaataacttactttgaaacataggaataaacttaacttgaattactggtatttgtatttgaaaaactaaagaactgcggcatcaattatatggacagacagcagtttatgtctcttctgagcagcgtacatggtggccacatagagcagcccaaggagcccctggctaacgcagccagcagcaggcacaagtggtagttagctgtatgctgtccactgcaggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaacttatttgtgtatataagtgcctagaatgaaaagtagaaagatgtatgccaactgttggcattagttgcctgtgtaataaaagcgagtattgaaaaggccctttctctgcatagttttttactgtttaggtactggagagatggaagattcacagtggccttgatttcagtgcctactctgtgcattgtattgatagttccattacatatattagcacagttcatttgtaaagctgatttgcaaatgaggaaattgggatgttatgttaaaaaaacttgcccaaggttatatcttgtgttgcttcgtgcatagatatttttaagtaaaaaggggttatagtgtatttaagagctttaactgctttttatttatcataagactgtagtgaagacatctttttatgtcgataaaggtagacctgtatcttcatttttaatgaccacatcatatctcatagaggtaccatagtagattcagccatttccctgttaatgaacatgtagagtgtttgcagtttcaggctatcacaagtaagctgtagtaagtatacacatatatttgtgtgtatacttgatactatccttaggatattattccagatgtgtgattgcagagtccaagaggatacaaatttccaatgttgacatatgttttgacattaacttccaggaaattcataccaattcacatccttgccaatatcccatattggcctttgtttaaatgtgtgctaaatccctcatttgccctatcgtgattattacacattgcatacctgtatcagaatagttcatgcaatccacaaatatatacacctactatatacctaaaaaaatgaaaaggtaaatactaaatcaataaatgtgtgataagctgatgaacaataacgttttcattggcatctttatatgattttgaaatattttatttgcaaaacagaaatgagcagccttccgctatgcacgtcatttagtcattaaagtgaatgacagtgatactttaattgacccagtgtgtttcattttttttatgctcaagatgtgaaattttgtaattgtaacaattacaaatgaagagcttgaatatcgattatatattattcttatttacacagctaatatttcaagaatgtttctagtctcatgttttgtacagaaaatctccatattttttagtcattttctcatatgcactgtttataatagaatggtagtatagagaaccctaaatttcatacaatgaaagaccacttatgtttggaatgagttatattgagaatgtaataattgaatatagttgtatttgactttcaggtaatattttttcactaaatcagtgactaatgcaatctcaaccaggaagtagccagaaagctccttatttccttcctttccttacttgtcagtgatggaaatggataataaaatgtctcataaggtgatcccaccagggcacagccattctctctctgcgtaagcttgaacttgtctggctcacactccccttgggaagaagagaattaagctggggcgtaatgaagtggttctgtccagagaaacattcctagtggctgaattatgaggaggaggaagtacacattcctgtgtcccttttattccatgttggacttcgtacaacgtggagccacagccaagagatgggaataggaagtcctagaactttttgcaaaaagtctgtgctctctagctttcactactgaaagcttcaagatctgatgtggccatatcctcctgggcagctgaaaattgagtctgtgccaccagttgactgggttgccctccctgctgtgttgagatccagctctgggaaagtagcctcacatgcaggaagccagcatctttcactgccccttatctctgtgccagacagacaatgcagccttcttgacagacctattactaacaagggaggtggcccgtaggctagtcattaattcatctgatgcatattgtatgcctactgggtctcatgctccgtgctggggattcagaagtgaacctgcctaatatagtccctgccgtcatggcacttacggtccagtggtagactgataatgaccacactagactgataatgacattagtaatcaattaagtctgagacatgctacaacagcaaaccatgtggtagtgctgtgagcgggtgtaacaggggtcctaactcagcccaccctttgctgagcagagcatggcaaagagcacattccgcctgggaggccaccctagggagcaccaggcacaaaccctgcatggtccagacacgcagaaaactgatgggattgcatgcatggccttttgagggtagactctctgggcctgtggttgcttcatggctgaagtccagctccttgtgggaatggccatcccactggcactgtcgctgaccactacctgtgtttgggctggttcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttggtgagtgtttccaactcggaagcttcagggagtggacggtcctcgttcttcgttaccagaaaaagaaaggttttcttccttttatcagtgagtgtaatgaggatacagaaaaagtttccacacacacatttcttccccgacaagcatgtttgcctaactgcttcctaatgttctcatagtcatatatgacgtgcttatgcctggctgcaacaaaaacatgtgaaatttatttcaggagctttccaccatccttgccaatcctgatctctgcttctgcctgggctggggaggagtcacccccctgcagtcacttggtgacttttaaaaaatgtaccttctatgcctgcctgaaattgagggcaaatcacctttccaaggaacagaaggaagtggctctgcttccatgaacaggaagataaagttaaaattggcacatttctggcaccagcctggcttattatttaatttggggccttagatttgggttttgtattataaaagcaaatctctgcctcaatcagtcttgcttttctagttcccctttgagtagttgtggtgctttctgtaaagcttccatggaacaccatttccttttttagtgctttttctaattggcatgctagtcttcttttcttcttcgtctttctggtataataacaacctttcctgttaacttttttttttttttttttttttctgagacagtctggctctgttgcccaggctggagtgcaatggcacgatctcagctcactgcagcccctgcctcccggattcaagcgattctcctgcctccgcctcctgagtagctgagattacaggcgcacgccaccacgcccagttaatttttgtatttttagtagagatggggtttcaccaggttgtccaggctggtctcgaactcctgacctcaggtgatccacccaacttggcctcccaaaatgctgggattacaggcatgagccaccacacctggccttttccagttaacttaaactccacatattccataggtgttttgtttgcttgcatttttgtatataagtgcatgggtgtggacacaggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgtgtttcttgtttgcaaaaagtaactaatttattaaattgtgcttcatccagtgggagctattgagagttggccacccatagaaaattgagggaggattttaggaactgctgaaggtttctgccacatgcatgattctgatataccctggaagaatccatctgagccttccccacatggacacagagtgtggaatgctagcagcacacagagggtggcagagcttgccctgcacgtgacagcacaggcgctgagatgtgtcccagaaaaatgagcaggtagaagcctacctgagacatccaacagaaacatccctcttaacttccttcctcctttagtgttttgaatcagtttatttggttgggaagtgtaagcaaggatagtgtacagagaagtaggaaaactactcctcttcttccacctgctctgcattagcacaacaggacaactctcactgagccttcctgtcctgaagatttcttttttcttttcttttctttttttttttttttttttgagatggagtcttgctctattgcccaggctggaatgcaatggtgcaatctaagctcactgcaacctccaactcccaggttcaagtgattctcctgcctcagcctctcgagttgctgggatgacaggcacctgccaccatgcctggctaatttttgtatttttagtagagatggggttttgctatgttggccaggctggtctcgaactcctgaccccaggtgatccacccgccttggcctcccaacgtgttgggattacaggtgtgtgccaccatgcccagcctgtcctgcagctttcaaagtgaaccatcttcgtgtatgtataatgagtgggttgcattcatatcatgtgtgttttatacactgaggtagattccagttacgtaggaatatagttagtaatagtgtattcctgaaaattgctaagagtggttataaagtattctcaccaccaaaatgataactgtgaggtaatgcatatgttaattaactaggtttaatcattccacagcatatacttcaaaacatcatgttatacacaataaatacatacagttttatctgtcaatttgaagttaaggaagaaaatagattggattttcttacaccttttaaatgattaaatattataaaaatagaaaccaatcacatgagagaaacatttactactgttgttgataaaagtacggggagaatgtaacgcactttagagtgaggaagattctctggattctaccactgcatctgttagcgccatggcatactgtggtaaaatggcactgttttccgatgctatgtacagcaagggatagcgccctgttttccccccctagagctaccgttacaagcatttgcttatgttatagccttccaataactaatatgttgaaaacaccaagacaccacttaaggtctttacaaagtgagaaggaattgggaaaaaaagaaacaaaggccgggcacggtggctcacgcctgtaatgctagcactttgagaggccgaggcaggcagatcatgaagtcaggagttcgcgaccagcctggccaatatggtgaaaccccatctctgctaaaaatacaaaaaaaattagccgtgtgtggtggtgcatgcctgtagtcccagctactggggaggctgaggcagaagaatcgcttgaaccctggaggcagaggttgcagtgagcctccagcctgggcaacagagagagattccgttctcaaaaaaagaaagaaaagaatgtgaatattgacatcacattaaaaaataataacaaactttagccttgtggcctttttttggcacatgttttccgctagttctcatgcatcatccctattctctctcttctctgtcttttcttcatccaggaacagagaaagaggacttagaaggaactcaacccagtacttcctaggattggaaggaagctgccttatttcatgtataagtggcaccagcttgactgtaggaagagagatagcgtgaagcctttcacatctaaactagaaagcttttaaacgtggtagtttgttgagttattctctctctgtggaatgaatgatgtagagatggtgagaaatcagagtgggtgattttagacatttccctttaccctacttcattcctgctctgtacagagccttgtttctgttcttcaccttatttctttgagcaagagtaaagcctctgattatgaaaatacactgtgcataaatagccagaaaacacattttcttgcaatgaaagatttgttttatggaaaatctcataaacaccatcaaggaaggttttggaagaaggtcaaatgtccttcaaaatgctattaccccatcaccattcacatcttagtgtgactgacatccgttctcagctctggtggggagaggtggacagagacagcagcactgtcccctgtggcccagggttgcctgtggggacgcccacccaagaagcaggctggagagaagtgccaaggggttaaccattgcctggatgatattttgtcaggaatctaatgtttttctctctcctgtagggggtgacaggtgctttgacagttttgatgaaagatgcaataaaaccaaacctgatgcagaccctggaagtaagtggttttcttcttatagtaattgtttgcattaactggattgccacacaatgtgaacatttttagccaatatgaggcaggcatagagcatgcctggggcagcagtgtgctttgcaatctcaggcagaaagagtgaggatctggttaggaacctgtattagtccattttgacattgctacaaggaactacctgagactgggtaatttatgaagaagcatcagaataacttcttggccaaccaaaaaaaaaaatttttaagtgtattcatagcttctttaatataagtcatgtcttggcttaattgacccgagtagaaacttagaaagtcaatgtctgaggccaggcgcggcggctcatgcctgtaatcccagcactttgtgaggccgaggtgggcggattatgaggtcaggagttcaagaccggcctgaccaatatggtgaaaccccatctctactaaaaatacaaaaaaattagccgggcattgtggcacacacctgtagtcccagctatttgggaggctgaggcaggagaatcgcttgaacccgggaggcagaggttgcagtgagctgagatcgcaccaccgcactccagcctgggcgacagagcgagactccgtctgaaaaaaaaaaaaagagaaagtcaatgtctaacatttcaataggttgtatggccatgtttacaatttattttctgtgttcccttaatctctcataatcattgagttgtggattttttggtttgcttttttattgttgtttgtttgtttccaagcaaaatacaataaatgccaagactttccaggaaagcatttgccaaaggcaagtcaataaacacacagcatgttagttggtggtaaggtctggagaagaaaaatcagaggtcatgaggggcagagtgatgtggggtatgtgtgtctgtgcctgcccgcctgttaaagcagtaccagcacagagctgagtaaaccaagggggtgagccatgcacgtgtcttgaagaacatttggacagagggttacctttagtgcaggggccttgggcagcaaggtgttttgcaatttcagacagcaagagcgaggatctggttaggaacctgtattagtttgttctcgcattgccgtaaggaactacctgagactgggtaatttaagaagaaaattggtttaattggctcacagttctgcaggctgtacaggaagcatggctggggaggcctcaggaaacttatcatggtggaaggcgaaggggaagcagacaagtcttcacatggcagaacaggagagagagggcgaaggaggaagtgctacacacttttaaacaactagatctcatgaggactcactcacaatcatgagaacagcaagggggaaattcactcccagaatccagtcacctctccccaggcccctcctccaacattgaaggttataattcgacatgagatgtgggtggggacacagagccaaaccatatcagaaccaatatgacagaaatggggggattggccaggcacggtggctcaagcctgtaatcccagcactttgggaggccaaggcgggcagatcccttgaggtcaggaacctcgagaccagcctggccaacatagtgaatcccatgtctactaaaaatacaaaataaattagctgggcatggtggcacgtgcctgaaatcccagctccttgggaggctgaggcaggagaatcacttgaacaggaggcgaagattacagtgaactgagattgcaccactgcactccagcctgggcgacagagtgagcctcttatcttttaaaaaaagggaatagaaaaaaatggggggaccatttctgaaggtgcccagtgaggatgcagactgcaggtgtcccctgagctgaggaagggaggactgaacgcctttgaacaggtgtctgcagccccgggggaggggtgcaggatgcacaggtgccaaggccacacccttctgcggcaggttgtccttcccgtctttcctctcccctgatcattctgccagcatgcacgtatcctcagaggtaggccatcttaaaaagcaaacaaaaacatttcaaaaacctcctgcccccacctgcatcctcatctagcttctgcccagctcttgtctgtcactggggtctccatgttaactgacctcgggttccacctctcctgactgcccttgtccaggtcacttttcccttggagacaccaagtctttgttgctgtgccctcctcagagaagctcagcagagtttgacacagctgcccttgtcttccttcaggagcacctggttcctctggcgtctggggtccccccctccccaggcctgctcgctgctcctcctccgctttgctggcttctctgatgacccctcaccttttttgccccgttctcctccagaattagccaggtgatgactcccaaactcttgtttggaatatcatgcacctggaatttcagacttgcaggtatagttaccaggagccacgtgggtggggaaaagccatttcaaactgatacataaaccaggacccacctcctacctacttccttccagctcgctgcttccctgaaaccttcccagtcattcaaggcagaaacccgaggatgatcctagaggcctgttttcccttcccctcttcctgtgtccatccctgcagagttgtccttggttacatgactctgccctgtccacgatgctcaatgcctccctccttcctgctttagctgccagcacgccccacctgcacgagtgcagcagcctcccaaccagtctctctgctgctactcttttcttccaaaatactctctcctcagcagccatagagactgaaacctaatgaagccctgttgccttcctacttagagttcttccatgatttacccatgtttccaccccggtctgaaaagccctagggatctggctctcaccccttcccgctccttgtcccttatcctcatctctcatcctctgggggacctttgcacggctaacaccactacctgggccacttcctgatattctcatgtccagctccttcgcctccctctgttctcatgtcatgtaagcatcagctgctcagagaagccacaggaatgtgcagcccccgtccctctgctgtcattgcagtacatggcacagaatgctgagagcttcctatttccttatctgttttctgtatttctcctcccaccgagatgacagcaagaccttttccatcctgttcaccaccgtatctccagcttctagaaagtgcccgacacctattagaggttcagtaaagacttgttgaataattaagtgaatgtttattatttttactacattctcctaaaaatacacatttattaataaataactgaataagagaaaaaatacgaagtgatgtgatattccttcataacacttctccctcaaagatgaatacttattattagggataatcattttctttattgttgttgtttgttttgttttgttttgttttgtttttttgagacggagtctctccctgtcgcccagcctggagtgcaatggtgggatctcggctcactgcaacctctgcctcccaggttcaagcgattctcttgcctcagcctcccaggtagctgggattataggcgcctgccaccacacccggctaatttttgtattttttttttaagtagagatggggtttcaccacgttggccaggctggtctcaaactcctgacctcaggtgatctgcccgcctgagcccccaaagtgctggaattacaggcgtgagccaccatgccccagccaggataatcattttcttgttttaaataattctttttttttttttttttttgaaacggagttttgctcttgttgcccaggctggagtgcaatggtgtgatcttggctcactgcaacctctgccttccggtttcaagcgattctcctgcctcagcctcctgagcatctgggattacaggcgcccgctaccatgcctggctaatttttgtatttttagtagagacagggttttaccatgttggccaggctggtctcgaactcctgacctcatgatccacccacctcggcctcccaaagtgctgggattacaggcgtgggccaccacgcccagcaaatttttgtatttttagtagaggcagggtttcaccatgttggccaggccagtctcaaactcctgacctcaggtgatccgtctgcctctgcctctcaaagtactgggattataggtgtgagccaccgtgcccggcctgagcactttttaaaacataatctaaacctgttatttctttgctgcctaataaatcagagattcagaacccttaaaaagcaaataaaagtaagggcaataagacctgctgaggctgaggcaggagaatagcttgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagagacgggtttcactgttggccaggccagtcttgaactcctgacctcaggcgatccgcccatcttggcctcccaaagtacggggattacaggcgtgagtcactgtgcccagccaattgtaatgatttttatggttaccttttcttgaatggaatcatttcttaattaaaaaaataaatataccttttataccatcagggtttaatttcattcttttaaaaaaatatagtgcatggcaacataaaataaggtaaataatttatttcatggtcattgaggcaactaacaaaatggtttaacaatattttggaaggaagtgactgtattctcacagttttgtctctcaggttcagcattaaatgtagaataacatttttctagaatccggagggaatttggtcctttgattgagtcagggtgttttgactgtctttgaaatattttatgcattaaatatgcagtattcataaaagctttcctaccccatttgccccaaattgatcttggtttccatgcttctgtttgtcttttgggattttgatttgctttttcacttctctaggggacacctgtgttcgtgcatgcgggcccttttgctaacattgctcacggcaactcttcagtgttggctgataaaattgccctgaaactggttggtgaagaaggatttgtaggtaagttatttcttttaaatttagttgttgtagaatattgaagaaatctaaaagctgatgactggaatggagtgatatccatcctgacatgaaacatattctttcaggcaccctctttcatagagggtctcaataatggaaaagccctaaggtctggtctatactcgtgaaattatgcttgtgcttgaatcatagagtctggtatcaagtacatatgggtttgagtataaactctgactcttgcaaactgagtgacattggacacattttaattactactgagcttcggttttcttgtgtgtaaaatagtgataacaatactgtatcaaaccttttagggttgttatgaaaactgaatgagatattttagtcattcagcaaatgttttttgagaacctaccacttagaaggcatgttagctagggatccagtggtaagcaaaacagataggcgcagtggcacatgcctcgctactcaggaagccgaggcaggaggattgctcgagcccaggagtttgtgtccagcctgggcagcatagaagaccctgcctctgtgaaaaaattaaaattaaaacaaccagccttagcccctgctcctgtggagcgtactgtctaatggtaattgaataagagaaagtgctcattgactgtcagccattactacccttactatgtagtactgataacttgaagtcgtgggtttatttccatgtacagtttctccttgttttttgtgagctaatataggagagattcccaaccagtagacttagaaatgttaattggtagtactgcacaccttttgctgctgtcaagttctttgcagaacctgttcctctttggcttttcttgcatattccagctagaaagaaggggcaactctcatagagtttactaagtcagtgccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttcttttttctttggatctttttattttttggatgattttatttatagttgttataaaatacacgtaacatgaaagttaccatcttcaccatttttgagtgtacgttcattagtgaagtacaccttcattgttgtgcaaccaagctgcagaaccgaagtcccatgcccattaaatattcctcattctccagcccctggcagtgcccttctactttctgtctcaatgaagttgactcctggataccccatgtgagtggaatcatgtagtatttgtccttctgtgactgacttatttcacttagcataatgtcctcaaggttcatccatgttgcagcaggcgtcagaattctcttccttttttttttttttttttttattttttgtgagatggagtttcgctcttgttgcccaggctggagcgcaatggcacaatctcagctcactgcaacctccgcctcccaggttcaagcgatcctcctacctcagcctcccgagtagctgggattacaaacatgcaccaccacgcccagctaatttttgtattttttagtagagatggggtttctccatgttggtcagtctggtctcaaactcctgacctcaggtgatccacccatatcagcctcccaaagtgctgggattacaggtgtgagccaccacacccggctagaattctcttcctttttaaggcggaataatattccatcgtatggatagaccatactttgtttatccactcatcctacattggacatttgacttgtttccacctttggctcttatgaataatgctgctatgaacatagatgtacaaatatattttaatgtctaaaaatcgtgctctatgatgtctaaatatgtgatggcaatgacttatattcacaaatacgtaccacggaactctagccctgtaatgttgaactctcccgaaggtggtgtgtccatgctgtggctctgttggaatgctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctcccaggtcagccagcaccatcctttggcatgtgagcaaattgacaccaatttgaggcccgaaacaaaagtgagacaaaaagacgttcatttcaacatccttctacagaagttaaatagagtaggcacatctgaggtgtatctgaagtctgagcaggaattcatgttcttcaaaaagttgtcgtttatagtagactatctttatgacctcataatagggaaggatctcttaaaatatgaaaagctcaaaccatagagaaaaatgtcgataatttggcctgcattaagaagtaaactgtatgtgataaaagatacaaggataaaaaacaagtgacagattggaaagaaacgtttgcaaagatagtagacaatgattagcattgagaatatgtaaaacactaaagactaaagactgataagagaaagacaaataatccaatacaaaaatagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaatatgaataagacaggtttcttgccctccagtaattgatgatgtgctgtgagagacaagaacttcaatggtaagtacaatgcacttgattaagtactatattagttaaggttcttaactaagaatttcaagggatgatgggcatctcttagatagaactgtctccatattactggttttgctgatttagtctaatttttgttctaacaaaaagcatacacaaggaaggaattattttgtctattctgaataattagtctaagataatagaatcagtagtccatttagacttaaaacagagtgacatttattttaaaaaagcatgaatttgcaaaacactttatgagaatttttcaaaaactgctgtgatcactgttgtggctgtttcttccgttagtcagcagtcctcatgggagttcacctaacttccatttacatgctgtaaaggcaaacagatatttggcatcgaattctaatcatgtattacatttaaaaaataaagcaaaaggaaagaaagaaaggaaaaagcagtattgagttcctggattttaaaaacattattatctcatctttaaactatttgtaggaatttcaaacttacccattaacttaggattttttaatttgttttctgctctctcagttggttttgattccagttttcagataaagatcttgtctttgcagaggagtgcagaatgcaattgtgtatccttataggcaggtgtcattaactgagggtcaccagccactggtggactcctggatagacttcgatctacaactctgtcccataattaaatataggttcgtgcatatggagacatatatatatacaccttttttttttttttttgagatggagtcccactctgtcttccaggctggagtgcagtggcgtgacctcagctcacggtgacctccacctcccaggttcaagcgattctcctacctcagcctcttgagtagcttggattacaggcgcatgccaccacactcggctaatttttgtattttcagtagagacctggtttcaccatgttagccaggctggtctcgaactgacctcaggtgttccacccgcctcggcctcccaaagtgctaggattacaggtgtgagctgccgcacctggccaccttttttttttaacctggagaaaattacacaattcttggattctcacaggggaccatgacataagagagagaaagaactgttggtgcatatctcaaagcctagctctacttttgacggtagctttcgatgtcccatacacatttggcatttattatccttatccagaggtgcttgtcaagaagctacctaattgattgcaactctgctgcttgctctctgtagagaatcacacagacctggctgtgttccccaggtgcttcctgggtacatgagcataaacactcatgcagcagaggagaaatatgagacaagtgcccaattaaaacacagggtgatctttgcctcagacatttcaggattaggatttagaaatcagaatgaatcgacttagcagttccaagacaaattgaatgggattgggaaacaaagccttgttaatattttcattaaaaacgcccccgtttctgagccattcctgagcattagaccggtgctgagactatcatataccttctcactcaatccttaaaaccgtctgtgggatcagtgttactatcctcatcttacagatgatgtaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctctttacctggttgccaccctctcccattaaaaaataattttagctgggcgcagtggctcactcctgtaatcctagcactttgggaggccgaggtgggtggatcacttgaggtcaggagttcgagactagcctgaccaacatggtgaaaccctgtctctgctgaaaatacaaaattagccgagcgtggttgtgggccctgtaatcccagctacttgggagggtgaggcaggagaatcgcttgaacctgggaggcagaggctgcagtgagctgagattgtgccatcgcactccagcctgggcaacaagagcaaaactctgtctcaaaaaaataagaagaattttgggtgagctgtctacagcagatggtcacagttacaggaagtaccaatataactatattgtaccaatatatcgtaatgtgcgccaacagtggtggtcctttttggtcctttttttcttttctgtgttctactttaacatttcttcctcccaagtaggttactgattgaagatgaccttatcgagtcccactgtttccttgctctacctctcaacctgtatttttgggggacagttttttaatttttttattttccttttttgagacggagtctcactctgtctcctaggcttgagttcagtggcacgatcttggctcactgcaacctccgcctcccgggttcaagcgattctactgccttagcctcccaagtagctgggattacaggcacgcaccaccatgcccggctagttttgtatttttagtagagatggagtttctccatgttagccaggctagtctcaaattcctgacctcaggcgatccactcacccctgcctcccaaagtgtagagattatagctgtgcaccactgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccacctttaaaaaaaaaaaaaaatctgacgtcaagtgatcctgcagctctaagctgtaattctcccagaccttgccctgtttacattatttaaaaacactgatctcagcctgggctccacttttgttattatgatgcttccaggttttttgtctttagtaaatttattcataattaaatcaaggttgagaagtgctggcttattagagactctggctgaaggtcatgtgcgaactcaggaaactgctaatcacaggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgtcctttgaaaacaaatgaaaaagcaaaatgttcttcatatacactaaacaggaaagtatgcaaagtaatgttacaaacacccatgttcccaccactctgtttcatcaaaatcttaacatgtcgctgtgtgtcctttagtttttttgtttttttaaagagatacgtttagctgggcatggtggcgcatgcctatagtcctagctacttgggagtctgaggcaggaggatcaattatgcccagcagtttaattctcctgggcaacagagtgagaccctgtctctaaaaaaaaaaaaaaaagaaagaaagaaaagaaaagagagaagagaagaaatcagatattagagacacagttgaagttcccgtggaccctcctgatcccgttcttttttctgcttctctcctgatttgagtgattatcgtttccgggtgtgtgtttctactttgaccacacacatatatgtacactagagatctgtagcggaggttctcagactttctctgctcgtgaccattaatggcccagcaatttttttcatggtaccgcccgggcaagagaaatacctaacatgtccatttattaaataggtccaaacaacttaatgagtatttatgtccttacaactaagtggccacctgaaaaaaaaatacatatgaattcgaaggaaaaaataacatcatttcatttttaaattaccaccatatgttatgaatgagatgtgtgtccttgtcaggcaccagacaacttctgaccctttgtaaccagttgacacccgcacctcatttcctgttccacgttgattttcacacgatttttgcattttgctgcggtacctgccaaaaactttgctttgcaaatatatgatgtcatggaaagggatgtagagcactattgttgaagcagtgaaaaacctcacatgagtagtatttgcagtgtccaacggatgtcctgtattaccgcgtttccgtcaaaaatttaaaataccccacggtgcctctgagtttgctgcaatgcctcacggcacctcattgcacattagaatcacagatgtgcggcttttcttggtattttttatgtgttttcaaattttatatattaatagatattaactgactgcattgttctctaatgaggtcactgcactttttctgtaaatggcaagatcataaatagtttgggtcacagagtctctgtcccaagtactcaatttagaaagcagccataggtaaagcatgaattcataaactagtccatgtttaggaatgagtctggctgtgttccaacagatgttattattggttcctaacatttgaatttcatataattttcacgtgtaataatactcttctgatattgttggcaacattttaaaaggtggccaggcacagtggctcatgcctgtaattccactgcttttggaggccaaggtgggaggattgcttgagcccaggggttcaagaccagactgggcaacatagcaagatcccatctctataaaaaaaatttttaattagccaggtttggtggcacatgcctgtagttccagctactcgggaggctgaggtgggaagatcacttgagtccaaaagtttaaggctgcagcaagctatgatcacacctagctacttggtaagctactatggacaacatggtgaaaccctgtcttgaaagaaagagagagagagagggagagggggagagagagagataatactttttaaaagagaaagaaagaaaagaaagaaagagaacactttttaaaaggataaataatttttaaaaacttaataatttaacatgtaaaaaaaaaaagatgtagaccatatacaaaacccagaggcacctggatttgtcctgctagccatactggccaacccctgctctataacttgatatttttgtgcaacataacagttttgcatttctctatgtcactgtgatccaaaaagcctcattttgcctgcagtttagccttctgtgcgtgcatgtagcacgtgcatttgtgcattatttgtcaaggggctttcagattgcttccagtgttctgctgttacaaataatgctacgggggacattcttgtccatgtctctgagatttagtctaaaaggtcttctagggactatatacaggagtgagatttggggggttaaaagtacgcttagcaacaacttaatagataaagccaaattgttctgcaacgtaataccaatttatatcactaccaattgtgtgtgtgagatttctgacctctccacgtttgtcctgacacttcttttttttttttttcttgagacagagtctctctctgttgcccaggctggcgtgcagtggcatgatctcagctcattgcaacctccacctcccaggttcaagcaattctcctgcctcagcctcccaagtagctgggcttacaggtgcacaccatcacacgtggctaagttttgtatttttagtagagatggggtttcgccaagttgaccaggttggtttcaaactcctgacctcaggtgatccacccaccttggcctcccaaagtactgggattacaggcatgagccactatgaccggctgaacgcttctattgttagatttttttagctcttgctaatctgatggtagttcattatagttgtgagatttagcatctttatggctgtttctgggcatttgtgaattgtctattttgtattgtgctatttacctttttcttactaattaatggaaatcctttatagattccgaatacgaatactttgccattatgagttacaaatatcttctcccctgtatggcttatcttttaaatatgcttgttgtaccttttcttgtccacccttttctttatgatttctgcttttggaggttataaagataatcatttgtattgccttataactgttgtctcttgcattgaggcctttaatcatcttagaatttgtttgtgtaatggtgtcttttttccttaactcttacagtttgtgagacttttctgccctggtgatatgtgcatcagtggttgttagcccagccctatgaaaagggccagctggcctccatagatctaaggcagccgagagtgctgtcccctttgtcccaggctctgcagcatccaaggcgagtgcagatggggccagctgttcttccaaaaccatcatctcttctttacctgctccttctgagcttcacctgacatggctgtgcagtccccaggaaaaagaaagtctctcttgtcttcctacttcctaagtcaatcctaggaactgttacgttcaattccaagcagttgtcataaaagaagtttccttggaactttgaaaacaaaagaaagggtttaattttcttcttttcgttttgttttgttttgtttttaattttttgagacagagtctcgttctatcccccaggctaacagctcactgcaacctctacctcctgggctcgagcgatcctcccacctctgcctcctgagtagctgagactgcaggcacaatccactacacccagccaattgttcaatttttttctggagatgaggtctcactacgttgcccaggctggtcttaaactcctgagctcaagtgatcgcctgcctcagcctcccaaaatgctgggattacaggcatgaaccactgcgcccatccaaaaggatttaattttatggtcaaattctacattgtctattgactttaatatttttataaaattctttaaataaaatgtctttacctggaataccttcaatgtacttactggattagaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgacagagtgagactctgtctcaaaaaaaaaaaaaaaaaaaaagaaagaaagaaaaagaaaactctcctttgaattaaggtaatccttcttgaaaggcttgtttaaaatgtttccttgttacctgggagagagcaggaagcactgggaaatagcacgtcactggtgcctcgtgccatttccgtgcctttccctgtcttgcctcagccttgcactgtggaatgcaaaagagtagaagaaactccaacgtgaaaattgtcgacaaacaatgcagagaatcttcggtggcattaaacattaaaattaaagacacatggtcttaaattcagctgatatacttgacacctcagatatactcttggtgccaaaagggatgttaagcaaaatttgagggatttgactccttatttgggaaagaccatgactaccaaggggagagaaaccagaggcaaaccttattgaaaaatggagtagctaagtcattttgtatatgttacttttacccagccaagtacagtctgtagttttacacagtgaatttgatctttactctaaattcttttcctttaatgaaagtgctagtcagtaatgcagaacttgggcaagttttataaatatgtttgctttacaaccagtcttattaagtcagggtatcatctaagggcccaatcaaggacttttcatttaaaaaagaaaaactctaaattgcattgtgatataacccttaaattccaactgtcatggggaatcccaagacctacatctgtatgtatgtgctgtgttctaaacactgctccccaacctttttggcaccagggaccggtgtcttggaagacaacatttccgtggttttgggattaaacggttccacctcagatcataaggcgtgggtcctagatcccttacatgcgcagttcacagtagcattcacactcctatgagaatctaatgccactgctgatctgacaggaggtggagctcaggcagtaatgctcacttgcccgctgctcacctcctgctgtgcgacccagttccttacaggggctgcagaccagggggttaggggtctctgtttttgtttttttggagatcaagtctcactctgtcgcccaggctgaagtgcagtggcacaatatcggctcaccacactcttcacctcccaggttcaagtgattctcctgtttcagcctcccaagtagctgggactacaggcatctaccatgcccagttaatttttgtcattttagtagagactgagtttcaccatgttggccaggctggtctcgaactcctgacctcaagtgatctgcccccctcagcctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagctaggaatattgggaaaccagccattgctaaaggaagatgcatttagtgtatctttctatgtacctcttaacatcttttgtggggtgtagaaaaacagattattagggctttctttttttgtggggggggcgggagcggggatggagtttcactcttgttgcccaggctggagtgcaatgatgtaatctcggctcaccacaacctcctcctcccaggtttaagtgattcttctgcctcagcctcccaagtagctgggattacaggcatgtgccaccacacccggctaattttgtatttttagtagaggtggggtttctccatgttggtcaggctggtctcgaactcctgacctcaggtgatctgcccaccttggcctcccaaagcgctgggattacaggcatgtgccaccatacccagctaattttgtatttttagtagagatggggtttctccatgttggtcaggctggtgtcgaactcctgacctcaggtgatctgcccacctcagcttcccaaagtgctgggattacaggcgtgagccaccacgcctggcctattagggatctctaaaagccgcaagcctcttgctagccatagctgtgaatgttgtcttaaccattaatgcttcagtataaataatatcaatttaaaagctgcctaagatttaaaagtactatgcaaattacaaactgcttgggtatctagatcaaaataaagcagagcaaagaagtaactttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtctcaaaaaaaaaaaaggctttttcaagaaccatgatggatgattaaactaattgtaagtatcagaacaagataaccctatagcaaaacagttaatagcagaggaataccctggagtgtcctgagatagatttcttccagtagtaatttgataagatgacattttatttttatttttatttttttcttttcttttatttttttgagacagagtttcactcttcttgcccaggctggagtgcaatggcgtgatcttagctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcctccctgagtagctgggattacaggcacatgccaccatgcctggctaatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagcaaaaaaaaaaaattattgttggtatcctatcaaggctagtaaaaagaatagataaatgtatacatggaacatgggaaaacattcacaaaatataaagttaaaaaaatcaggttgtaaaataatatatctccaatttgtatgagatttatatctatatatggaatgaagagatatagaagtatatcaaatgattatttttgtttgcctggaggtaatggaatcatggtgattttcacttcacactttgtgatttggcattctcaaatttttacaattactgtgtattacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccaacaatgctacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaatttagataatttgggtgggtttttttttggacagtcttgccctgttgtccaggctggagtgcagtgatgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagccagtctgggctggtttagcaactccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgttactttttgtcctgtaaaatatgcttaccaggccgggcacggtggctcacgcctgtatcccagcactttgggaggccgaggcaggcagatcgcctgaggtcgggagttcgagaccagcctgaccaacatggagaaacactgtctctactaaaaatacaaaattagccaggcgtggtggcacatgcctgtaatcccagctactaggaagggtgaggcaggagaatcacttgaacctgggaggcggaggtggcggtgagctgagatcacgccattgcattccagcctgggcaacaagagcgaaactccgtctcaaaaaaaaaaaaaaaaatgcttaccgggacatctcaaggacatcattcctttgtcaacggtacaaagataacctgagacataaagtgaaaatgatttatggttttttgttttcttccttacattaaattttccaataacatatcgctaataacatatttcttttgttttgagacggagttttgctcttgttgcccaggctggagtgcagtggtgcaatctcgactcaccgcaacctccgcctcccaggttcaagtgatttctcctgcctcagcctcccaagtagctgggattacctgccaccacatcaggctaattttttgtatttttagtagagacggggtttcaccatgttggccaggctggttttgaactcctgactttgtgatccacctgccttggcctcccaaagtgctgggattacaggcgtgagccacggtgcctggccaacatatttctaataatatattaatttgataaacagaagttattttggaaataagccaaaacaacaaaaaatgctcatccctgcttttcaaggctattatctgtagtttgaggttttatcaaatgtagatatgaactgcgggcctcttcaggatgtcctcattgcttctgttaatgcttttaccatccagtaccactgaacaggcagcagggtgccttcttgggcacaccggaaggacccaggaaaaggaagatagtgtggcctgttcttgtctccatgccccaaaatggaccactacaccagtggggtaggaaatagcaggtgtgttatgggttgagtttggagaccttgacttgatcaaccatctgctcacccaggtcatctttcctttttttgcagaggtgaggtctcactatcttgcccaggctggtctcctgggctcaagtgatcttaccgcctttacctcccaaagtgctggtattacaggtgtgagccaccatgcctggttcttgtcaccattcttaacatcagcagcagcagaaaaaccccctgtttagccttcaatgttaatttcctccttgatctatgtgttctacacaaaccactcccttgttgtcccccatatattacatttgtggactcttctcaaactctgcagctcagccctggttcctgctgagcctacagccccaggcctgagcagccggctgggccaagttaccctcagtctcaagatgacttcctcacaaggcaaaacatttctccagctgggttggagacctaagctggggaactgggctctcacattccaagatagaggtttgcctatggacccctgaaagtaggcgtgtagaagcaggttcctctgatggcagaggccctctgtttatctctgaaagatcctgaatgctatgcttctttcatcccctctgccttgaattcgcctgctttctaggtgcggtggagaaagctgggaaaagagccacctctgctcccaggggccactgagagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgctacatttttgctgtccggctccaagtctgtgacaatgggtcacgggatcagtgcgagtaacagtgaagatgtttttcttcatctttgggctatgattgtgctttgtgatcctaagtataaatacattgaggctgggcacggtgtctcacacctgtaatcccagcactttgggaggccaaggcaggtggatgcctcgagcccaggagttcgagaccagcctgggcaacatgtcaaaaccccatctctacaaaaaaaatacaaaaattagccaggtgtggtggtgtgcacctgtggtcccagctgctcaggaggctgaggtgggaggatcacctgagccctggagatcaaggctgaagtgagttatgatcgtaccactgcactccagcctgtctcaaaaaacaaaacaaaaaaaatacatacactgactaataacaccagcaatattgtttcatgggagctgcctctgctgtttgtaccaaaactgagcagattctttaggccaggcccgagtaatcattaaatcgatctgcttgtgagaaaccggtaggtctaggcatgagcacaaagtggcaggtccgtctcttcccttcttaaataaggaatcaccagaggtagactctgtgcctgtgactcttgaatgtttaactgaaatccagagcagcaattgcattttatatgacaccatgtgtgtgcaaaaactgaatcaaaatcttgtgaaacagtgctactttcacttactatatatgatgtagtctaataattttctatcctattttatttcctttttttaaatgctggttgaaattctgtaaatttatataatgacaaactactgggactctatcttggttcaaaagtccatgatcagcctgcttgtattgagttactacattgtacgatcttataattgtaaagtttaagatattttccttctgtctgtcttaatttattctgtaatctaagttgtcctgccaggaatgctggcatatttactttgtttttgaattcaataatcatagtttctcttgctaagttacattaatggtaccaaaaaaaagttactgcatggtttttgaaactgttctttcctaggaagttttaaagtaaaatgtttttaccttttattgtttacacaggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaacatgggaactatttggataatggatttatgaatttaattctgatggatttttataaaggagctaaaaataagcctatataatttattacatgtataatcatataattttaaatgtgtataatttataatattcatcgaaacatttctttttggaaattaaatttcactttggtcaaaatcatcttacaaaacaagatgactcatgatggttctaaataatgtaaaccggtgtctgtaactaattaatgctctggaggaaggaaattctgagttctgacacaaaagcacgtctaagtggtattggtattttcaaagcttttactacaaccaaaaatatgttcacgtgtacctgtctcctctttacactgcttactttctctatcgcttttcccaaatacgtccccagtaacttcctcatgttctgtgcaccacctccaatcttcccctaatgtgtatgaacttggtcatcaccaaagaggtggaaaggaagaagggcatgtgctaatattaatattgaggtttgggctgggtgtggtggctcatgcctgtaatcccagaattttgggaagccgaggcaggtggatcacgaggtcaagacattgagaccatcctggccacatggtgaaaccccgtctctactaaaaatacaaaaattagctgagtgtgatggtgcacaactgtagtcccagctactcgggaggctgaggcaggagaattgcttgaaccagggaggtggaggttgcagtgagccgagatcgtgccactgcactccagcctggcaacagggagagactctgtctcaaaaaaaaaaaaaaaaagaaaaaaattgaggtttgtgccagtttctttttcctttaggtctcctgatatgtgtctagttagttctatatacttcctggaaattcgactccaagatatttaataaaactaaacagggttatatgttgaatagacaaatcctaaagagcagaaaggatttagtggttagtgaaatttcattgacttaagatgagttggatcctcaaaattaatatattctaaacaaagttctatttttaagctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaataatttagagctacttgttaaatgctggagtattattgaagtaccaagtgttaagattttcactgaaagcaaaactgaccaagcagctcagctagggaaatgctatgtgatcagttgattgtttgatgaggagtatggagcagggactttggcagaggttgctagcagacaggccttggttttagtccaagctctatcgcttaatagctgtgtgaccttggggaaaattataaaattttccagtccttagtatcataaactgtaaatggaggagaaagatgcctcacagatgttgaaggtgaagtgagacaggacacctagtacattgcctggctacatagaaaatgtttcacaaatgttaacttgaggccctctccccatgcctcggtctcttagaatggtttttccccatcgtgtgcacattgagcggtaaggcggacagctgccgccgcccatgctgccccatgttgagagcatttctgttgaccttcccttcttccctgtgaagctggttcagcagtcacctcatcactgtttttcttctccagagagtgctgggttgtagcgaccatactgttgacgcaacacatcccaaccacgctggacggaatttttactgcgataattcatattccaggatcttacagtgcacagggttacaacgattagcataatgatcttgcacaatctttctgcctagcatgtagtgcattcgtaatattctcagaggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcacccgtggatgatcatggaaaggcagctgcctggctttccagaattgttttgactctccatctgaacccagagctctgtttcctgtacaggttgctagcagtatttacccaaattgtcccttcccaactcagacccactgacccttcctttctcagctgattacgggtttaagtttgaatcaaaccatgctatagaatcactatctagcagcttctgtgcttgcacaataagagtattagtcagcgtttcctgttttcattcatattgtaagttgaatagctgtaacaaaagggaaagagattgccaagacaaataattcttatggcttgtgcaaacaatttattacaagccttattaaatatgcagctttcagaagtctacgtgatatgcctttcagcaaagctaaatcctactatgtggacttgcttcatgacttaagaacaagtctatattgaatttaacattaaataattatttggcctgtatctcttttaagctttgttaagaactgcaaatatgataagggaataaattgctcatttcaagtcactaagaaaacctaacctataggttatatatgttggcagttcccaagaagtacctaggaaatggaaccttcctataagagtggtttgtccccttctcacgagatgggtcttcatatcaaggccccctaaggcacagatacacagcactccacagtgtccaagttcgtagtaattggtggcaccttattaaagtagtttttactttcataattactgattacacatcagcataccttttccatgttctgtttccttggcagcctgatatttgaatacaaacgacataaaagtgattacatgcagcatttcaggacagttttcaaactgagagaatttggcactttcttttattttcttcccattcttcgtctatttcctttgcatttggaagccaaactcctcgaacctttacttctgcatgttgttttcgtcccctagctagagttctctttattactacttttttgtttccaattggtctctttttaaaaataaaacatggtgaaaccccatcaatacaaaaattagccgggcatgatggcgggtgcctgtgatcccagctactcgggagactgaggtgggagaatcaattgaacccaggagacggaggttgcagtgagctgtgatcgtgccattgcactccagcctgggcgacaagagtgaaactccgtttcaaaaataaatgaataagtaaattaaaatatgaaattaagcttagctagcctgtgtagatgttttagatggtcatatctttatcggatatgacatttatgcctttcagtaaaaccattgtagtattgtaagaaaaaaagggaagtatgatagggaggactaagaacatatttgtacttctatgtaatgctattttatgtgtctatttccattgaagtgtggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaagaacttagagatcacttgatcagcccccgttatgtaaaatgtatgcaacaatctacctccaactatagggcgacattaaacagtttttcaaaataccatggcattgaaaaaaatgcgtaacatttgggttacttcagtcccactccccggtactaatcaggccagtgaaccagtcttgctggtgaaataatgacttctccagtcatgatggatgatttcccttcatcatgaccatttcttccctggctctgcctttacctatgaatctcttctttcctccctctccttcctcctcttggtctctgcctgccatacccaactccacatttctctgcttggaaaaatcctacttgattctcagagcctgactccatcaccccctctctccaaccctcccaggcaaactccgtccctcccagtgtgccgccctccagctctctctagttgaatagcagatgttctctctcccacttccctgcagggcttcagggtagtgaccctaagagtgagcttctaccagtgagaaaaacgcctggatggagcaggaattcccacaaatgcttaggaattcaatatgatttttagcaagtgggagaattatccttttggttacaaagatgtgaactatttttgtgagttctcagtatgcaccaagaaaaaccccagtgactcagtaatgtacctgtgccgtctcacttaacccttccaacaaggaacttgccaaggtgcacagctgggagggatccggggtcccgtccgtgtgctaacctgcaggacagcgccgcataatccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaaaaaaaaaaaaaaaaaaagagtaagaaaggatcttccattgtaatcatactatcattgccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaagtgcccacaccgccttcctaataccaaagaaatttcattatgttaaaacagaattgagcatttgaaaaattcctgcccatttaatgactatagttttctagagtatttttcttaaaactttttttttcctgtagacctccctcgtggacatctaaaacgttttttgttttgtgttgttttttgttttttcccaacaccaccatagggcactttgagtttagtaagttcgagtaaacagtaacacccacagttctttctaaacaatattttggaaaggagcataatgcaaccactttttagtctcaagcttcacatctgatactcaggccaagattgtataaccatatggtaatgggaggttagaggctcttgtccctgaacgaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgagacgaactgccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccagtggtggcgggcgcctgtaattcccactactcaggaggctgaggcaagagaatcgcttgaacttgggaggcagaggttgcagtgatctgagattgcaccattgcactccagcctgggtgacaagaacaaaagtccatctcaacaacaacaacaacaacaaaaaaaaaaaaaaaaaaaaaaaaaaaaaaaaccagcagggaccaggaagccctgtgaagctaggcatccctctcctgggctccagtagtaccttctgcctcacattgtttcatgaatgccttgttctgtgtctccctatgtaattctcaattccttgagtttagggactgtgtcttattaattggtatggtccaagtgtctggcatggtctatatgcagggagtgttttcaataatggcaagataaatgaactttcatcctcttaatcctctattccatagtgctcatctcggtgtccttccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgtgattgtgccactgccctccagcctggacaacagaactttatggcaattaccgtaaaatgatttcgaatggtgatgtactctgtataaatcaagtattaaacatattattagttttatgttctaatttgaaccaatgtttgagaagtttcatactgttccattggctcaaattagaatcatccagggagattttaaacattactgatcccaggttcccctcccagaacttctgctttcattggtctgggtggagcccagggatcagtgttttctaaaagcttcccgcaggagtttaggtttagccagtgctgccagctactgttttaaaagcacaaaacatagaggtacatttctaaaaattgaatgtgattatgttgttctttctttcagatcggttgtgtaagcatttttataggattattcttcatgttttctctccttatttcaggtaacggctggtgttcctcttaagaaagaatatacagaggaggtaagaggagctgtttagatgcttatgtgaagaatctcttaaatccagtgactcgttggctttcagtgaatgagccctccttcagtggcctcttagaaaagtgctgttctgtccgggcgcagtgactcacacctgtaatttcagcactttgggaggccaaggcgaccggatcacatgaggccaggagttcaagaccagccaggcaaaacccatggccaacatggcaaaacctcatctctactaaaaatacaaaaattagctgggcatggtggctcacgcctgtagtcccagcatgagaatcgcttgaacctgggaggcagaggttgcagtgagctgcgatcgcaccactgtactccagcctggacgacagagtgagactctgtctcaaaaaaaagaaaagaaaagtgccgttctaagaatccgagaggaaatggatgggatgaaaggataaaattcattcagttaactcttaaatatcaagaaaagatggatataggctttgtctactattgtgtactcccagggtagccatcagagcaggaactcaaggtctccaggtcagaaacaaatatgaagcttacacttctgtattcttttgtcatggaaggtctatatacagttggctttatgatttacaggagtggcttactcttttctgtaaatagactttgatttgctggcagcagtacctcttagctcctacaggtggcgccagggatctgagccaggaatacctggtcagagctcctcacccacctggggccttgtgcctgtcaggcctcaacctgcagagcatgggcgcattgcatagaccctgcagcctgtcctcagcagggtgagctgccaggcttcagacccacccatatgccattggatccagaatcattttagaaattattttgaagacgaacctctttattcttgcagccatctttcttggaggaaaaagtgaaaaaagatgtagcaaatcctgccagagaggtgctggcagtttagcttggcaggtttggtgggagacaatacacaggggtctgggttttgcttttttcttttttacagaacatccagctggtggcagacggctgctgtaacctccagaagcaaattcagatcactcagctctttggggttcccgttgtggtggctctgaatgtcttcaagtaagtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagcctgtgcttttgaagactcccaaatcgcagtcctaagtgaggaggtactttagcgaacaggatttgacagctgacgctttcaggagttgcacaggaacaagagcaatttcgtgaggattgggaaaccatgggaggtattttccttgttcatttctcttttttttttttgagacagtctctgttgctcaggctggagtacagtggtgcaatctcggcttactgcaacctctgcctcccaggttcaagcacttctctgcctcagcctcctgactagctgggattacaggcacctgccaacacgtctggctaagtttttgtatttttagtagagacggggtttcaccatcttgggcaggctggtctcaaactcctgatctcatggttcacccacctcggcctcccaaagtgctgggattataggcatgagccaccacacctggcctctgcttgttcatttctgttatggttcttttctcttgtggttttattgaactatgtctagtgtatgtgtgtgtatatatacatacataatatatttatttattttcattgtggtaaatatatatataacaaaatttactatcttagccttttttttttttttttttttttgagacagagccttgctctgttgcccaggctggagtgcaatggcgtgatctcggctcactgcaacctccacctcccgggttcaagcaattcttctgcctcagcctcccaagtagctgggactacaggcgcaagcaagcgtgcctggctaatttcttttttattttagtagagtcggggtttcaccgtgttgcccgggctggtctcgaactcctgagctccggcagtccacccgcctcggcctcccagagtgctagggttgcaggcgtgagccaccacacctggcccatcttaaccatttttaagtgcacgtcagtagtgttaagtacattcacattgtcatgcagccaatctccagaacgcttttcatcttgcaaaactgaaactgtacccactgaacaactccccatgcccctccctacagtccctgccagctaccattctccttcatttccatgaatgtaacaactccagggacctcatgtaagtagcatcatactgtggctggcttatttcacttagcataatgtgcgtgcatgttgtagagtgtcagaatttcccttcttttttttttttgagatggagtttcgcttttgttgcccgggctggagtgcagaggcaccatctcagctcaccgcaaccttctgctctcgggttcaagcaattctcctgcctcaggctcccgagtagctgggattacaggcgtgcaccaccacgcccagctaatttttgtatttttagcagagacagggtttcaccatgttcgtcaggctggtctcaaactcctgaccttgtgatccacccacctcggcttcccaaagtgctgggattacaggtgtgagccaccgcgcccggccagaatttcctttatttttcgggctgaatacgctcccattctttggatatcccacattttgtttctttgtccatctgtggatggacacttgagctccccctcacagctattgtaagtaatgctgtatgagcatgcgtgtttatggcatatggcatatgtacaagtatcccttcaagaccgtgttttcttttttttttttttttttttttgagacggagtcttgctctgtcgcccaggctggagtgcagtggcgcaatctcggctcactgcaagctccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatgcttctgagttatgctgtctcagacatgcactaaccctaacatgaacccttttcctttccactgatatttcaatttttttttctgaattcccattcttcatgcagataatgctgctaaaatgtcagctctcttctgaaaggaggaaaatgtttaataataatgtggtctaaagtcctctattgataggcgacctcaaggccaggatccctgcctcctttgccaacacacttctcgcttttcttgtaacagaaattcgatttgagctgcataattgtttgttagataatcagcctcccagcctactgcagcatgacagttcatgaaaagagctgctgctgctgctggctctctttgtactgtctgcctgttagctgtgttcctcacaccagcaagatttagatcatctaagaccatttacagtcttgtcttgtcaccatgtaaaaatctgaattcattggtgcagtcagtaatagagctcaagccttctttgccccggatttcttgcattgattggtgctggtaaaactttagtaacttaagtaatggttttctggaagccctttttacctcccctacaaccccacaccctcacaaccaacccttgggtgctgggcagtgagaaagatatggcattgctctataggagaaagaagttataaatgctttgcatatgacactctcccacctttgcttctcaaagcaaactgggtttctgtgtgccccttggtgtctccccagactttatatccccaagaatgtattcagtacaagactaatggcatcttgtgtgctattctttctccaccccagtcttgtggaaggaaaacaccggagatgatttagggtaatgggaaatagtgctagagcccagggcatgactgcatttgaatgtgaagtagaaattgtctcggaaccccactggagagtgattcagctggagagagtggggcacctggctctcagaggcactgtgcggccagacagcagtgtgctggacttcctaatggcgagctcacaggttaagtgagaaacaggctgcacttctgacttgggagtctctgctgaactttatagaaaactgacttcagcagcaactgctgtctagagaacaatttggcatctctttttgccagagtaacttctaactcaagagtaggcaacttttaattatggtaccggatggaggcagcaatgaataatttagaataaagattgaaaaatatggaataaggtgtagtagactaattgctcagaagaagttttattgtgtgaaaatgaatgtgtttaaacttgaaatacagaggatcatttcctctctacccttgagggtgattgcagtcccttttaagaagctgttaaaagtccccctcaagatcatcttctctttgaattttcctttctaatgtgacttttgacaattatatctttatcgttcactaagagaatatctccatgtctgcagggatgcagggaaatatgatggctgaaagaaacgctaatctacatgcgcactttattagctaagaaatccctcctccatacgttcttccaggcatgcctccgcacatcccatctgctatgtgggctcaactctgcattatagatgggaaggtgatggacttgtccataagaaatggacgcttgataggagaaggaacatattacatagagctaacaggctaaagctttgggatcatgcaaattaagtttaaaccttgagtaggcctcctactgtggacacaatttggggaagctgactaatctctcgagcctcagcatcctcatttgtacaatggtgtctgacagtgacaccaacttcaccaagttgctgtgagacccaaatgaaatgccccagagtaaaatgctggaacatagaaagcaggcaatgaaggccaggagtggtggctctcgcctgtaatcccagcaccttgggaggctgaggcaggtggatcacctgaggccaggagttcgagaccagcctgggaaacatggtgaaaccccatctctactaaaaatacaaaaactagacaggtgtggtgtcacgcacctgtagtcccagctactcgggaggctgaggcaggagaatcgcttgaacctgggaggtagaggttgcagtgagctgagatcacaccactgcactccagcctgggcaacagagttagactctgtctcaaaaagaaaaaaatggaggaaagtagtcaatcaatgctggttcttcctcctgtcatgttcacttggaaagagagtgggcctcctgaattcaccttcaagaattctcctgtaactcaaggtaactttgtcaaactccaagattggtttattttgctctgggttaaaaccaggaattagaagtcaagtctcctaaagcactactgaactaaaccaagacactgacgtttttccttctccgtgagaattgggagcccttagtgatatcataaaacatcagtcatttttgcaaagaaggaggtatgacccggagaagtcagcttgacattcagtcggaatattgtttgttaaatgaggagttaaggttgaaaatcatctctgtatccttcctctagccttgcaaacattttaaggtgtagccttgacagcaagacaggatagtgtttgtttttattaaaaggtctttcctgttccttgcgtgaagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggcagagtctcgctctgtcacccaggctggagtgcattggcacgatctcggctcactgcaacctccacctcccggtttcaagcaattcttctgcctcagcctcctgagtagctgggattacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaagtcagatttgtagaagaggaacgagcagatgcatcatgagaacactgtgcttggccaggcgcggcggctcatgcctgtaatcctagcacttagggaggccaaggtaggaggatcgctagaatcgaggagttcaagactaacctgggtgacatggcagatcctgtctctactaaaaatattttaaaaattagccaggcatagtggcacatgcactgtagtctcagctactcaggaggctgaggtgggaggattgcttgagcttgggaggcagaggttgcagtgagccaagatcaccccactgcattccagcctaagcaacagagccaagctcaaaaaaaaaaggccaggcacgatggctccctcctataatctcaaccctttgggagactgaggcgggcagatcacttgaagtcaggagttggagaccagcctggccaacatggcaaaaccccatctgtactaaaaatacaaaaatgagccgggcatcgtggtgcgtgcctgtaattccagctactctggaggctaaggcccaagaatcacttgaacctgggaagtggaggttgcggtgagccaagaacatgccactacacaccatcatgcccggcctgttttttttgtgtgtgtttgttttgggttttttttgagcctgggcaacagaacaagactctgtctcaaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgagtaagatgagacgcccctactacgttataaagccttcatggatctttatttctaacagttcatttttaaacttttgttccatttcattttattttgtccattttttgtcatcaaaaaattattttaaaatgtaacagctcttctagaatgtacagatcaattttattccactaaaaaacaggacttcaataatttaattgaagaattctagtgagcatttccagagcctttccaagaaagctatactgtttaactttgagtgactcagcttctaggaccctggtccaccacacctacaaaatgaatttaataaagcatgaaggtcaccaaatcctctactatttcttcgtggagtcattcagctagtgtttatgttgtgcctgctctgtgcgagagactgtgccaccaatataaccactggtcacagttattttctagagccatactgcctgatatcccatgtggctaagattgacagttcagtttctggattgttccagtcccatttccagtgcttttaatagccacatgaggccagtgaacacacgatacatcttccattgtgatagaaagtggcagtggacagctttgttctagagtatttccgtttctgaaatacatgtttaagaagtttggaaaggaattagtgtagagtatgagaagggttacatttttggtgaatatgaagatttaacataatgttagttcaaaaatgaccaaagacacaagtgtagacaccaggcttttgaagtagctaatatgttaagcagctgtgcattatatagacagaatattcactatgtcccactcagccctgtgtttgacaccatttcaccttggcttctgcctttctttcccttctttgcctattgagatttttcctgtcctttctatcctttttttttttttttttttttttttttgaggcagagtcttgctgtgtcaccaggctggagtccagtggcacgatctcagctcactgcagtctccacctcccgggttcaagtgattctcctgcctcaccctcccaagtagctttgactacaggaatgcgccaccactcccagctaatttttgtattatttaaatagagatggggtttcaccatgttggccaggatggtctcgatctcttaacctcatgatccgcccaccttggcctcccaaagtgctgggattacaggtgtgagccaccgcaccaggcctcctgtcctttctttaatgcactattccagctttttttttaatatcttgccagcttttgctgattttcatgcctccctctgcaacctgtgatctcttgactttaatagtaatgtttatacagagtcttgactgcacactctcttctgtcatcgttgtttgttgtgtctcattgtccccaatccatcagaagttcttggtacacaaagtccctgaagctgtatgaacaatgccctgacgtcttgaaaggacttgccataggtggttatttgatcacttagcagatgcctttgggatcctactttgtgcaggccactctccaaggcacaatgtggcaagtaaatatattagtcaatatttacagaaccaagagaaagccagcaatgattaatgcataaacagtcataaattggccattttatttgtttataaaagctatcatttactacagagaagtacaagtgaatatcaagctcagatcaagacctttggactgagcttggctttttttttttttttctttaaagattacacttctcccccaaatcaagcagattaaccataggaagttccttgcctgctaacagaatataaatagattgcatgcaaggggaaggaccttatcagggcagattttagtatttacactaaacccaaaagattatttccttaattgtacttgtgagtgaaaaacaaaaattgtagcaggagtcccaagagcactctggccatgggcttttgagctgtgagttgaagcactttattcagcatgtggctgcagggttgtagctcaggttgtagacagtgcattctcttcaggtcccaggaaacagtgtcatacctgtggaagccaccagaatgcaccttcatcttctccagtggtggcgaggttgaggccaagcatcagaagtgctgagtgctgggaaactgtggggctggatagatggcagtgcctgctgggaagcacacagccctgggttgaggcagggaagcagggccgcccagttgggattcattcgtactactggcccctcacagtaccgtcatgtgtgggtggtcgcgcttgtcctacaggaagtaaaccacaactactcatctcacacagtcagcccggcacctccttggaattcccaaaacactttccaataaacattggaaaggaagaaagtttagttggtaacaaaaaaatgtatgttgccttacgcccaaaagcattgaaagcagggactcaagcaggtactcatgcagccctgttgatagcagcattgttcccagtagctgaaaggtgggaacccccttgtctgtcagcggggatcagctaaatatggcacacacatactatggaacattattcagccttgggaaggacacctcctatcacacggatgaaccttgagaacattatgctaaatgaaatacaccagacacggaaggacagatactgcttgattccacttgtaggggcctgtagagccgtcacattcatagacaggaagtagaatggtggttgtcaggggccaaggggaggggcatggaaagttgctgcttaatgggtacagtttcagttttgctaaatacagagagttctggaggttggttgcccgacaccataaatggacttaacgctactgaactgtacacttagaaatggttaaaatggtaaattaggccaggcatggtagcttgcggctgtaatcccagcactttggaagtctgaggcaggcagatcacttgagcccaggagttcaagaccagcctggacaacatagcaagacccccatctctacaacaattttagaaattagctggtggcttacacctgtagtcatagctacacagtatgctgaggtaagaggatcacttgagcccaggaagttgaggctgcagtgagccgtgatcacatcaccgaactccagaatgagaccctgggtcacaaaaaaagaaaagaagatggtaaattatatgttatgtgtacgttaccaaaattaaagttcttaaaaatatatattttaggccagacacagtggctcacacctgaaatcccagcactttgggaggccgaggcaggcagatcacctgaggtcaggagttcaagaccagcctggccaacatagtgaaaccccatctctactaaaaatacaaaaattagccaggcgtggtggcgggagcctgtaatcccagctgttcgggaggctgaggcagaaagaattgcttgacccagaaggcagaggttaccgtgagccaagatcgcgccactacactaccagcctgggtaacagagtgagactctgtctcaaataaataaataaataatatatatatacatattatatagatagatagatagatttcttacaaaacattttcgtgtttaaaaataacaaatcaggccaggcacagtggctcacgcctgtaatcccagcactttgggaggccgaggcaagcggatcacctgaggtcaggagtttgagaccagcctgaccaacatggtgaaaccctgtctctactaaaaatacaaaattagccgggcgtggtggcacatgcctgtaatcccagctacttgggaggctgaggcaggagaatcacttgaacccaggaggcagaggttgcagtcagccaagatctcgccattccactccaccctgggtgacagagtgagtctctgtataaaaaaaatttttttaaataacaactcagccatccactcgcatcaatttattcactagtcattcgattgctattactttgctcccatgtgagttttttaaattattaacagaaaaatcacactctttatttttgaattatgatcttgagttcagtaaagaatgcattctgttgattaaatgtgttatgagtaacagtatcttgttttgctgtacttccaagcaaaatgtaattctttcagtcctccctaccgttctcactccataataatatgacttaaggtttgtatagcatgacgtttacaacgtgcttgcgttttacactgactcaacgtgtgcagtacagtgatgtatagtgaagtattcacatcctcatcttagaaatgaggaaataaattcagggaggttacatgatttaaccacacataaggaggggctgcattctctctgagcccttctacctcacacagccaccaagctcctttgtgcagagcccatggagggttggagtggccacactggggtaggtgcaggccagagactggatgcaacaggaacattgcctgcttcccaaaaccactgttctactgcccggagaacacacccttctgggagctgacttctaacaaagcaaggtccttggacttgccctgcggcttctttcctgcaagaagtatcttccagcatcctaccaacttttatttcttaaaaaaggttgttccttgccaggcattggttgatcagcagaggagctcgcattagtttcagtgcagtgttgggagcaagcacttgagtgcccagcaacataggctgctcatgatctaagattcatggaaaaagtcttctgcgctgttgcctgcagcacatcaacacctgaattttcttatcatcttgtgtggctattgaaccacagggaacccaagcttagtcaataggaaatatagaaatattcattggttcaactgtatagggagggccttgtatatattccaggggctgtatcctatcttgcctctaggtaaataagagatggtcccgaggctcaaagagtttatcaaccattctttattcttcagctaatatgaacattgaatcttttacattagaagttgcccatgcagggcacgcctgtaatcccagcaacctgggaggccaatgcaggaaaatcacttgaggccgggagtttgagaccagcctgggcaacatggtgagacctcatctctaccaaaaataaattttaaaaaaagttacccttaaatttctttctctaacccagcctcaactttgtactcaggcagtaactctttgtacaacattcctggcaccatattcagcttatacagaaccctccaggcaaggacaggtcactgctaagtgagagagctctggttattatagttcttccttaaacactgcactcaaaacgacttccttctaacgtttgtcccttggttcacattctgccctcctttcgattttttgtatggcatggccctccaagagatttcagtgtcagtgtggtgctgccaagtctgtgtgactgttcacacactcgggctccattcacacaccccaagattgcatgagcttttgctgcagccactcacagtcaggccccagtgaatccctgtcctctgaagctgcaggtaggagcgccccaagggcatctagatgtcaaagaagaggatgctcacatgtgcctaaggttcatccatgaaggcttcgtggaggaggtggcttttgggatagatcttagaaagctcagagagttttaacaaagattggtccttgaagattactaatcttttgactttataaatacttgcatatatcttcttccagtctgtctcttattttttgaccttatttataatgtcttcttaaaacaagttttaaattttgctgtagtgaaatctatatatcatttcctttatgggttattctattgttacctcatttaagaaatccttctctacttcagaataatagagttcccactgttttcttccaatatgtagagttataattttcaagtttatgcctttgttccatattgggtttatttggaggcctggtatgtggtaggaatataattttatttctctccagccaaaagtcagatggtagtcagcctttctctgttgatttgtgtcacctctgttatatactatcctgcacatgctgagtgtctttgtgggttctttcttcttttccgttgattaatttgtctatacttgtgccagtacccatggaatttattagcatagttttgtggtatgattgatagctagtagaaaagtcctctttctttgttcttttggttttgttttatttttaaagttatctgactatttatgccattaccctgtgttagttcactctcgagttgctataaaggcatccctgagactggttaatggataaagaaaagtagtttattttggctcatggttctgaaggctgtgcaagcatggcaccaacatctgctgggcttctggtgagggcctcaggaagcttccactcagggcagaaggtgaaggcggggggagccagtgcatcacatggcaagagcgggagcaagagatggggtgggaggtgccaacaagcagacctcctgagaactcagagtgagaactcactcattatcgtgaggacagtaccaagccattcatgagggatccgcccccgtgatccaaacacctcccacctggccccacctccaacattgaggattacatttcaccatgagatttggaggggaccaccatccaaaccacatcaaccctttattgtaagtttcagaactaattggccaagtaaccaaaaatgagcttgggatttttattggacttgcattgaactgagtaagtttcagagaagtgacgtctgtacagtgttaagtctcctcatccatgagcaaactattttcctccattgactcagactctttttatgtccctcagtgaaaggttataaggcttgcaccttcatttctttttatttgttagaatattcaatatttatgttccagaccacagaacacctctacagtaataaaaactgtagtaatgaaaaacacgttttaaagcagttttgggttctatcagggttgggaggggaagagtgctagcttttatttattttctcttgggtaactcttgtatcaatagtatttcatacaaatgtgacactagctgttgccaagcaaagtccttgaggcacatcacgggagacttgtgccccttggttgacatctgttccatcagcatttggttcagcagttgttcaccaaacagtaaatccactaattgcatcatgcatatgctttctttttttttttttttgagacagagtcttgctctgtcacccaggcttgaagtgcagtggcgcgatcttggctcactgcaacctctgcctcccagggtcaagcgattctcctgcctcagcctcctgagtagctgggattacagaagtgcgctgccacacccagctgatttttgtacttttagcagagacggggtttcaccatgttggccacgctgatcttgaacacctgacctcaagtgatccacccacctcagcctcccaaagtgctgggattacaggtgtgagccactgcacctggccacatatgcatctttacccacaggaggattgtagataattttgccaaatgtgtttcttaaatttagaattactttatctgtggaatattattttcctaatgaatcattcttgtttctgaagatcccttgccgtatgctatcaatagtctgtgtcctggttttcaatctaacattatggaaatcttctcctccaacacacttatttgcctgtatctagtcttctcacatttcttccatgccacatgacttctcataatttgcttaagtgacagtaggttcaacctctgattttccaatatagtgtttgatcacatcagcatttatgttaaaatctcaatccattactgctcatgaaaaaatacttgtttttaatactatgaacccgtattcagacccacttaaaaaccagcactcacaatttcgttgggagactcctgtcctgacatatatgattatttgaaaattatagtaaacaggccaggcgtgatggctcatgcctgtaatcccagtactttgggaggccgaggtggacagtttgcttgagcccaggagttcaagaccaacctgggcaacgtggtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttgtccgctgagattgaaggctccatcatcttctacctctagccactgacaaaggcaagtaggcaaacagctgggaaggtggctgtgatctgacagcatgcatcaccatctagtccagtgacagtcatgatcaatcaactccactacaggaggctcagccaccttcaccaaaaggaccgtatgcctcgagtgtccctcctactttggtgtagtcggatagatagcagtcagaacactttaagagcctgctggctaaagaacttcatgatgggtagcgttgaccttttctttaaaaaaaatctccaactccttattcttttttgtaaacccatttgaaattttgttaaatgctgccgttgccagccagggtatttgttctcctaggtttggtaaaatagtcagcaactcaggaagttctaaattcttagaattttccctgtatgttcttggcttatcctttacaaaaaggattcccaagcactgctctgtgcacaggcattgtggtgaaattttcattcatgtgcaatgaaccaagtaaaataaggtcattctcataaggttggtttgtttttttttccgtgagtttttaataatgatatttaagactatcatttattctaatattaagtcttttctcctttcagtgttaaaatggtatttcttttatgaagtaatctggtgagagtatatggcatattggttggtttttttctttttaatatgcctactgacaaaatttttacattagcaaacctgtattagttcatagaaattacttcaatatttaaccatgtctgaaatttaaaattctggcaccatttctgaaagacagttgtgattgtcactcagcaaaattcttatcggtatagaagagtggagatttcaaaaagaaaatggccccaagtccaagtcctccctgagttgataagactctaagatcttccaaatagttttaggctaagtcttatgaaaatttaactaaagatttcattccctttatctctatcaaggaaatattccttaaaagtgatgtcaaccgggcacggtgctcacacctgtaatcccagcactttgtggggtcaaggcagaggatcagttgaagccaggagtttgagaccactctgggcaacatagcaaaacctccatctctatttttattttttttttaaagttagtgtcaagtatgtggttgcaatgaattagcaaagcctctaaaggaacactgtgtgccatttaatcagaaccaggctttgaggacactgtgctttttgtgagacaccacatgtgacttcctgctctttcacctttggaactctgggtcagacatagactttggtccttaaaaacaagaagcttaaatagtgacctcatcttagttcttataatgtaattgcagatcaaatagccatgattcataaaccaacacaaaggaaccctttgcttcctgactgactccagaatgagtgaacaacatgagtaagagcctcgtcgcagagcctttctccagactaccttgctgggtcccggatattaatagtcttggaaagtggtttctacagctgctgctttgcctgaaaatagccatgctttccccaaacatgcacataacactgccttctcttaaagagagcctccaaaataaacaatagtcacccttgacctgctaaacagtcatcacatggagatgagtttttatcctcaccttcttgcttcttcagtgaacaagtagtaacaagcagctcctgcgtgtgcctcgatctgagccggcataccattgctgccgagactgtataaagtgcaaattgaaaagcacaggagactaacatctgtatcagtgaacacattttctttcctttctcacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacggtgagtgagtcacattttccaaaaaccctccccattctgcattgctgtggtgcctcaaatcgttatgctccgcccgctctttaaaaatcatggattagggaaaattgggagtaattaatagtacagtattcgctatttttctaaacactgtgtctcacctacttttgccattgtggtttggatttttctttttttagatcatgtgttcagggtccttagagtcataatactaatttccttcctaaggtgagtaagaacataacttgggagaattcagtctgttatttaaatggtagaatggcttaagacagtggttgtcaacctttatcacacatagcacccaaaatgatgtcatcacggtggggttgactgctcacaccagacaggatctgcccagtcaccccaagggctggggaaagcagtcctcaccctctctcacttccccagcacgtcaggtgggaagctctggcttaggaaattactgaatcataggagttctcatttttgatgttgttgtgatgggatcatgttgctattggatgattattctgttattttgtgttatctatgggggtaaaggagatgggcagataaataaaagcttatcaaagtgcttaaaatccatgaagatgggcttcatttggtacagctacacagtgatagccttccgttggtaccgtcagtggcctaaatttgacttcttgtctttgggagtgctcctaaatttggtttagaacaaaaaagaattcttacaacctagcagatcccatggcaagcaaagaaaaaaatattctaacccatcattatcgtcatcattagtgcaaagtgatctgagcttaaacagcatacattatcataattttttataataaaccatgttgctttattgtgcaaacaagcaatagatagataaaaagtgcagattcttgccttgatatttacatacttcatctaatattggacacaatgttttttcaatcagcattttttgaattcttcctgcatgtgaggcacagagattttaggatgagcaggtgtgagacgcatgggtttgaatagcacagaggtatctggagagcactgtgttggtattctgaatgccctcagagcccagggggataacagctcattatgcctggggtagaacttacccaggatgtggaagaagaggggattcttcaaaaagagctcagcctctgaactggcaaaacagtgagttttgactcaaaggcaccaaagtactaatacatgacatcctctcctggggtgatccgatgtggctggagttggatgagggggggtggctggggatgggaatgggaatgggattgggatagcaggacagggtcacatggccaaggatcttgaagaccatctcatggaacttgaatctgatctctacacactggggagccacggtagggtgggttttttgtttgtttgtttcttggttttttgtttttttggttttaaataaggaggagaagaatgtggtctgatgtgtattttagaaaaatagctctggcagcaatatggagaatgtttagtgaaaagagaaccaggcccagagaggtgggttaattcagctcgggccagaggcaatcaaggtccgcactttggccacagaagtagatacagagagtgggggtgaattgcagacatactctaaaagtatcctcctaccgtgggggccgggggaagggaccgttctagcttggtgactctggctagtgatgccatcggtcatggaaaggacacgggagaaggcagattggcagagccagaaatgagcctggcttgaacagagagagctcagagggttaataggatctaaggaatagtctgtgtctccactggaaatacagacacagtgcttcaaagaaagaggcaggaaggtcaccctggtgggtttaaggatatgggtgaaggcagtcgttaaacaagagacacagggatagctggaaatcagtgagaagacagtgaaggaagacacccctgaaacacccacgttaatgcagccgactcctagcaggggtgccttccaggaggcgggaaggaaggagcagcggcatggcagagaacgtccagaaaaatcccacagacaccgctcgtagcagtgttggcacagggagaagggcctggatgaaatgggttctgaatgacattttcaggtctacagttcagatcagtggttgccaggagttgggggaggggaagcgtttgactgcagaggggcaggagggaactttttgggataatgcaaataccctatgttttgacgtggtagtgattccatggctatatacattcttccagactcatagacctattcacgtgtgttgcccaggctggactcaaactcctgggctcaagcaatcctcccacctcagcttcccaagtagctgtgactacaggctcatgccactgtgccaggcctgtgtataatttaattatacctcagttaacaaaaatgggtgctgaagagcttgctttatattcgttagaatggcctcagtcagccgggtgcggtggctcacgcctgtaatcccagcactttgggaggccgaggcgggcggatcacaaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagctggtgaaagccttggcttagggataagagggcggctggacagtgcaggcccagagagactggaccatcaggggaggtgaggggtgacggaggtgcccaaacagagcatgaaatggtagagtagctgagaaggttagcctcagtcacgatctgtcctgtcctaccctctgaggactctaaaccccgcagtagttcacccaacaaattcattcactcggccaatgctgcataaggcactcagctcggggctacagggagccccaactttaagaagctttctctgcttcaggtagtttacaggtggtagacgcagatagaagtgaattagtaaagagaatagtttggtgtaaaaattgtgcatttaactgaaaccttaattcactactgagcatttaatagccattaaataaaaaccagggcccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggtgggaaaattctagcaaaatgaatcactcttctgcttagtcacccaatgtgcacttattagggtgctgctgaaatacatattcatctatccactccagaaagatagtccaaactgagacctcaggatcagaaagcctcccattctcctgcagggttcattcatttactcagtgaattattaaatgcctacagcacgcagggccatcagccccacagctatgagaaagattcagtccttccctcacaggccttatgatagactccagtaaataaaaccatacaggcacagaatgcggcgggctttataacaaaggcagaaagcccctcttgttgtgtcctcaagggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctcttttttttttttttttttttttttgagacagagtattgctctgtcgcccaggctggagtgcagtagcatgatctcggctcactgcaacctccgccttccaggttcaagtgatactcctgcctcagcctcccaagtagctgggactacaggtatatgccaccacatctggctcattttttgtatttttcaaagagactggggtctcaccatgttggccaggctggtctcaaactcctgacctcaagtaagccactgcgcccggccatctctcacagtgttttttaaaacaacaatgcattttcataacagttggcctggagaggtgtccgaccaagttggaattcatagtagaatccattggaagttaatttttgatgtatttgactgttttccattgacttcgcattgaggcagtgagagagacttgaagaacttagaatacgcacccttttgtcactggcaaacatgggacatagaggcgtgtcttgacagcaatttgtggcaacactctgggctggaatctaggggttagacagcctggccggttttgtaaattagatagccaggccaccctcagagtcagtttgagggttgagtgggaagcctgaataaaaagagaagttaaacttttaagaaaagggtcaagctttaaaactggaattgggttttcaaatttaatgaggaaaaagaaaccccaaaactggaattgtaattgtggagaaatacaactgataatatttggaatatcatctacaaggaatgaaactatccagaagcatttagatggtagtcagtgccatgtagggcacctctgggggcagggtggctcctggcactgtggagaaagacgactggtgcttccttctcccaatcggaggaaagggatacactgtggaggtcccagcagcttagggcctgccccccatgtggttatctctgtgccgtttccttccctctgtcttcctgtaactccttcactttggcccctctgccctttctgggcagagggtgacaggaggcaccgcatgggtacattctttttttttttttttcttttttttgagacagagtctcactctgtcacctgggctggagtgcagtggcgcaatctcgactcactgcaacctccatctccgggtttcaagcgattctcctgcctcagcctcccgagtagctgggattacaggtggccgccactacgccccgctagttttttgtatttttaatagagatggcatttcactatgttgttcaggctggtctcaaactcctgacctcgtgattcacctgcctcagcctcccaaagtgctgggattacaggagtgagccactgcgcccggccaactacatgcttttttcctcctgtcgggattggcctgggctgtacctatctcatggtggaaacctgcccagggaccaggccctagaagaccagcagtttatttaactgggttggcctttgtccccactccctgtgacccggccctgccacatctttacccaggtgcaccactgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaaggtttactgcagttacttcctttgtgtgtcctcttaccttaccaagtcgcctcacccaccatctactgttaattaaattaccacctcccccacttcccacctccagagtagagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactagggaggctgaggcaggagaatcgcttgaacccaggaggcggaagttgcagtgagttgagatcctgccactgcactccagcctgggagacagagtgagactccatctcaaaaaaaaaaaaaaaaaatgggttcgcatgagccccctccttgggttcaattaagttcctaggatggctcacagaactgagagaaacacttatttacagaggtgttatgatatatattgattttcgtccatggttcctggttcctgaatcccataaaccttcttacagccttttgttataatgttgggggtgtcacgcctcaggggcaggcctctgaccttccctgccctccttgcactgtaatgtttcccccatttctgattgtgagtcttaagaccctcccatgagagggtcccaccctacaccttgtgggaaggaatgtggatgtcatgaagtgtccataaaaacccaagaggacagggttcaaggggattccagatagccagacatgtggagcttcctggaaggcagggcacccaggtcgggcatggaagttctgcacctcttcccccatacctcgccctacacacctcttcatatgtgtcctttgcaatatctttttgttgttgttgtttgtttgagacagagtctcgctctgctgcccaggctggaatacaatggcatgatcttggctccctgctacctccgcctcctgggttcaagcgactctcccacctcagcctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgagccaccgtgcctggcctgtagtatcctttataataaactggaaatgttaagcatgtgtttcctttagttctgttagctgctccagcaaattaatcaaacccaaagaggggagtcctaggaactccaatttgaaaccagttggtcagaagttccagaggcccagacttgcgactggtatggtggggggcactcggccctgtgggatctgacactatctctgggtagacagggtcggaactgaactggaagccaccccacctggtgtctgctgcttggtgtatggggaaaccccatacacatttggtcacagaagtcttctatgttgatgactgttgtggtgcgacagcagaggaaaacacggtttgaggagagcttttcccaacacgcttatgtgtgccagtttattatagaagacacagatgaacaccagatgaagagatgcatagggcatggtctgtggagttggggttcacctccctcctggcacaaggatgccttcaccaacccagaaactcatcaagtcttgttcaaggatttttgtagagcttaatctccactccccgccctccacccttcctggaggttgatgggtggggctgaaagttccagccctccaatcttctacttacttggtctttccatcctgaggctagctggaggcccaccccgtcactccattaccttaagctcaggtgttattgaaggagctccttatgaatagagcaaaatcacccctatcagaaatttcaagagttttaggaaacctgtgactggaaccaaggacaaagatgaaatatattttgtatgatagcacacccaccagattggatcgtggggccatatggcctttagtgtggaagctgcttgaccacattttccgcccatgcactgccattctcatttcaggctgcgtcatcatcatcatcaccatcacctgttcttagcaaaggtcgcacaccttccaaatgctttgtatagattagctcatcactccccatactcaccctgggagcatagtcagggataagaggtagagttctagcgctctgtggctactatggtttatgggatctttgcgcaggaataactggactttaaacatcttggcttttcttttcagtaggtcagtcggcatgtactcacagggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcattgcacagatagctgtacagttttttattatttatgataacggtaactgactttttgttaaagctggtttggaatctggaggttattttaattttgataactttatgattttaacttttaattttaactttatgatgtttgtcataaaagagtggaatgtgctcctattttgagatggaaacatttcggcagggagagagaagagagacaccaaaccacctaacagccaggttccaaggggagattcattcagcgtctttgaagcattgttagttttcatttgaggcataaattggaaacttatatctttctttggagtaggaagtatttcagacagaaaaaaaatgattgctacaacaacatcacgaaaaagaacagaaggtttcatgaagagtaataaagttaagtttatgaattagagcttcagatgggaaatcttatttggacagtaaatggttaatggtacagggacaccatgatgggggatctttgcagcattgaaaaaacacgcgtccataaatccttctctagcacttctttgtgatcacagagtcaagctgaggacaatgatggagtgctccagttcatccgaagtgcacgagtcccctttgcagcagactctgacattcccggcccctctccggagtgttatcaacatgcagtcagtgctctctacgtcattactttaaaaacaaaaactcggccagcagcagttcagtacatcttcaaagatcttgacttgtaattttttcccctgcatcttctctattgagcacatgaactgacatctttctacccccaaataatcagttctttccccctaaataaaatgggtaatccaaaaaagacccatcaaaaggaagctaaagatagtaatgcctaggtagtttcgggaccagaatgattgtctctaaatatgtacatgtacagtgattacgtgtttaaaatgtttaatgacttggagaaatagtgtgttgagtggagaaaaatgagatttagtagagcataacgtcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctattgtgccttgtggagattttcctacagcttttctggctgacccgtcacttgcactctggaactctcctaaaccagatacggcccaccacgtggcatggtgtggatcctggactttctgtcatccgttaggttcatattcttgaagcaagtctagaactattttctgagagattccctggctgttgttctgtgtttgggtgggttagtcacctttttaggtgagagacttgatttgggtacacagtttcacaaaagtattgtcaaccctgctggccaagtgactgacgtgctgggcatgggagcacactccatcggcatggcagagtggattcactccatgccattgccagagaataggactttgaaccacagccacccggctttttctgaaaggcctgcttgggcaatgatgcctggagaattatctgaagaatgcagtctgtccattcctctggagatggtctagtttttatccccagaccaagctgaacctcttagagctgtgcatttatattgtgtggaattgccttcagcgacgtgttctataacgtcgtgttcttgtcaccttttgagggacactggtgctgtggggaagatcctcaccaatacgcaacagcagggccctgttctctcacctgccatcccctctggaaagctcacagagagggtttcctgggttgctccttttccaagcaggacttctactgtagacttacagctccagttacaagcctgtgtgcttgtctgtttccccacaaggtgttctgacctgggagggaagggacggaatcctattcatctctgaatcctaaatgccaggcctagcacttggcacacagtgggttccagttgtggaatgaatttttttcagtcctgacaataaatgttggggttctttagtttgtttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagagtgagaccctgtcttaaaaaaacaaaaagacccatgagacctagactccccctgtcaaaaatactcacacacacacatatacgataagatagtatttctaccttttctttctcaaaacattccacagaacagtcttaccttcgaggagagccgtatgcatgaccttttgtttgtttgtttgagacggagtctggctctgtggcccaggctggagtgcagtggtgccatctcggctcactgcaacctccgcctcccaggctcaagtgattttcctgcctcagcctcccaagtagctgggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggttccagactcaagcccttcctctaatgtagggcgggtacaagagagacttgagcaaggatattgggatttaagggaagggcagtgcaggccaaggtcagcaagaggacatctctaagatgaacagcactgcatttgtgggaagcaaccctgccataaacaactcagttaacgtttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattgaggagtgctgggtactaggccattagaagaacaaacaacaacaacataggcctggaccttgcacttgcagagttcacaggctagagaggcacacaagttaaatatagagacagctgaaagagctgacgtctgggacagagggagccccctgctccaggagccagggagcagatgccatggggggctggcagggatagggaagtcaggccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaagaacctagaaacaattttaggcggaagatagttgtgttgggagcccctaagaccatgatttattacagcacaaggatacaaagcaaaattagcaaaaggaaacagcacgtggggtcaagtccaggggagctcaggcgcaagcttccagagtactctccccatagagtcacacaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagcttgcagtgagccaagatcgcgccactgcactccagcctggagaacagagactccatctcaaaaaaaaagaccttttgctcctctttgctcttgtgtctgtttaacagatttttatgttaacaggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatatttgaaaatatacctttaaaatcaaagacatgaatttgtgttttgggtttttttttttcagatttgaataaagcagagtataatattatagttgctgcaggaagttatgagcatttctggaagtgcttattttcagcacatgctacttagaattttaaaggacattcagtgtatctttgtcatgaatctttctactgggaccaggccactcctggatgaactcacagattgagagcttctcaaaatgtaaaatcaaattgtcttttaaaatatgctattttaaagttctggagaatcaatgaactttaaatgaaaatcggccaatacttggcaaaaagtcaatttgaagagttgtctctttataatctctgatttcacttatagagcttgcttccaaaaaaagtactacgtatgtcataaatctgaaatgttttgcttttatgccatttttaagtcctgataaatattcttgaagtgttaaattattattattattattatttgagatggagtcactctgtcgcccaggctggagtacagtggtgtgatcttggctcattgcaacctccgcccccccggattcgagtgattctcctgcctcagcctcccgagtatctgggattacaggtgcctgccactgcatccggctaatgttttgtatttttagtagagacagggttttaccatcttggccaggctgttcttgaactcctgaccttgtgatccgcctgcctcggcctcccaaagtgctggaattataggcatgagccgccgtgcccagccagtgttaaattatttttaacttgttagaaataattgtcccacaacttactgaaggttggtttaatattcactattgttcccaaaaaactcttaaaatattaaaccaactcatagctcataacttttcaaggtagcaagtgtttgctaatcttaaaatgtgttactattctttttttgttttttttttgtttttttgtttttttgttttgagatggagtctccctctgtcacccaggctggagtgcagtggtgtgatcttggatcactgcaacctccacctcctgggttcaagtgattctcctgcctcagcctccccaagtagctgggattacaggcgtgccactacgcccagctaatttgcttgtatttttagtagagatgaggtttcaccatgttggccagactggtctcgaacccttgacctcaggtgatccacccgccttggactcccaaagtgctgggattacaggtgtgagccaccatgcccggccactattcttaagtgaccttctgcacatctctgtagttttatgcctggtgatggcgtttaatttaggagtatctggcatgccactccagtctgacagctaggggcatgttagcaaagggggcatttttcaggtgagtgggtgagcatagccgtgctgaccatctttcctatccagagggaaggcctagcagggactcacgccatcttgacttgcctgccccaggctccctctcactgctcccctggcctcttcctcttctccagacaatggggccttatgctcgctgtgtttgtcagaactctcttgtggttgtggctgcaagtaagagaaactcaactcgagcttattcagaaagaggggatggattgacccagataacagaaaagtgctaggctagatctggccttagccacagctggatccagccttctggcatttgtgctccgttcctcagccctgccccactgggagtgatgccttctgttcacagtgtgatctgcttcatactcaaaactccctatccagaggaagaggaatcttttctctcccaccatctgcacagcagtattcaggaatcccctgccaggctctgttggcctcatgtgccctgtcctaatccaccactgtgcccagccagggtgtggccatacatgcccatcctgtgcatagggcaggagcagacccacctgcaccacatgcggtggccgccatgaccacaagaccaggataggagtgctgatcaggccagaccccaagggctgttgctcagaccatacctggcctgtagagtagaagaactaaatgtctcacacaggcaaagactactcttcaattcctttaattgcaggtgtatgttggagtccatgaaatacaaagttattgagaagcataactaaatttatagtagctcctcattatatattttcatgttgataggattctgcccccatgggaattaattttcttcatcaaaagtgatctccatactcacaaacactgaatagctttgggcttttaaaaacaatgttttggctttaaaagaaccacaggaggctgggcgcggtggcttacgcctgtaatcccagcactttgggaggccgaggcgggcggatcatgaggtcagaagattgagaccatcctagctaacatggtgaaaccctgtctctactaaaaatacaaaaaaatcagcctggcgtggtggcaggcacctgtagtcccagctattcaggaggctgaggcaggggaatggtgtgaacccaggaggcagagcttgcaagtgagctgagatcatgccactgcactccagcctgggcgacagagcaagactccatctcaaaaaaaaaaaaaaaaaaaaaaagaaccatggcaaaagtgtcctttagccgggtgcggtggctcacacctgtaatcccagcactttgggaggccgaggcgggtggatcacgaggtcaggagattgagaccatcctggctgatacagtgaaaccccgtctctactaaacatacaaaaaattagccaggcgtggtggcaggcgcctgttgtcccagctactcaggaggctgaggcaggagaatggcgtgaacccgggaggcggagcttgcagtgagccaagattgcgccattgcattccagcctgggcaatagagcaaaactccgtctcaaaaaaaaaaaaaaaagtgtcctttagtctactgttggttcttccaaagagccatcctttcgctgatgctttaggaactcccaacctgggtcctgtcaaggataagctctcatcttattcccacaaaattcctagagttactcatcattttcctttcatattcagctcattaaagcagtttgtaggtctctgtagtccatattagtaagtgttaaaaatgtatcaatttgattttttttttttttttgagacagagtcttgctctgtagcccaggctggagtgcagtgttgcaatcatggctcactgcaacctctgcctcctgggtttaagggattctcctgcctcagcctcctgagtagctgggattataggcgtgcaccaccacgcctggctaatttttgcatttttagtagaaacggggtttcaccacgttggtcaggctggtcttgaactcctgacctcatgagccaccgctcccggccatcgatttgattattataaaatcaggttatattggtttgaccagttaaaaacatcacaggttatttaatctttttatttatttatttatttattgagacagagtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagtactttttcaggctcttaatgtttccatccactaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtgtttctgtagttagcatcaggtgtccttggttctgtttaccagcctgtccagggatcacttccctggtgggatctctctggtgaccctcatctcagagctcagcggtgcctttggggctacttgccagacaactccatgtgacagagggccaggtccaagtgctcgatcaccccagccaccatttcagagttctcggattatagatccctcaacgagtcccagtgagacaccgaacatgccatagaagctatgtttttctatttcagcacacagtaaaacactacctcttagatgtcgatgagtacatgctgcttttatgttgacgcagaggacctgtgttgactcttcatcggcaaggtgtcttttttttaagtttcaattgacacataccacctctggcccaagtggaccacacagttatgcatgccctttggtgcaagatacatcacgtctccaagaactcgggtgtttttctgatcatggagaattagattccacatatagcttgtatttaggatctgcagattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaattgatacaatggttgtgttgggtgatggagatagaaagagggagaagaagtgaaagtgaaattttggtcaaaattggataccaccctaataagccgggagataaggggtgctgcagaactgttttctgtgatacagtgcatctacattgataatttgtgttttatgtacttttaaaatgaggctttattggcttgatttctgtgagaaaaatcactaatgggctgatcgtactgctctacttcaacatgcaagagaattgctcagacgcttgtcagatgcctgaaccacatacttatttgagaatgtgccatcataggaagctttcattcaccaaggtcaccgagagggcagcccagggaagcacgttgaacttcgcatggttctggccactcgtgtcagtagcaaagcaaggaaataaggagctgacttgcccaaaaattacaagttcagagaaaacggacttgttttgtttggaaaaggcagataacggagcagtaactaaagaatcctctttttttattattattgttgttgctcaatttataaacctaaacagaaaatgtgtgttgccttatttcctcttcttttctacagataactttcttttaaaacattctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgatacataatgttatgttaaaagcacactgcattctagagaaggtagagtaacagggtcttactttaccctcccacttgaaacaagtaaaaaactggacaaagtatatgaaaaatacatcactcagggcattggacaccaggcagcaaaaaacagtggcccctgagaaattggaaacaaagtgagtcctataattgtccttatctagaaaaagtttcctggctactgtgtagagagaaggaacccaggagaaagagctcaactgtctccctgagttgaagacagagctggggatacatcaagggaaaccaaggcagctagtttgcagaggtggaggaccggagaggagagaactgcatagagagagctttgcggatgtacagagtcctccttgagcatgcaagtgcgtactgatcaaagtgtggttgtgagaaaactacccatcaccagagaaaggatcacccgaaagaatgagggaacagtgcctgcctcccacacagtagccaagaagaggtgcctgttgccaacagctagagtgaaaacctctgaatgcaggggcactggttagaatactaagaagggtcttgccagacatccaatccaaaattagcaggcatgcaaagatctaggaaaataccacctaaaatgagaaaagtcaatcaaaactaacccattatacagatgatagaattcatagacacggacattaaagtagttgttgtgactgtagtttgcatgtttaagaaactagaagaaggatttaacatgttaaatagagacaaagaagatataacaaagatataaatcaaactgaagagatgaaaactgcagtgcctgaaatgataaaaaaaaaaaactcttaattaatagcagattagacattgcaaaagaaaagcctagttaacttaaagacatgcagtagaaactatctgaaatgaaacagaaaaaggctgaaaagaagcaagagagcaacattgagctttgggatcattttaagtagccaaaaatatgtaaaactagagtcccacaggagtggaaaaaaggaactgaaaaatatttgaagaaataatgggcaaaacgttttcaaatttgatagaaactataaactcatacattcaaaaaaatgagaacattttaaaaagagaggataaatgacacattatgtagagaggaacaaagataaattggctgatgatttcttgttggaaacaacacaaactagaaggtggtaggtcaatatttttaaagcagtgaaagaaaattcacagcctagagttttttacctggttaaaatatctttccaaaacaaagctgaaataaagactattttagacacgtaaaagctgaaaaaattcatcactagctaacctgaagtacaaaaagtgttacagaaattcctgctggcagaaagaaaatgataccagttggaaacctgaatctacccaaaggaatgaagaacaccaaaaatagtaaccgcatggatagaaagacttgttcttactgtttatcttaaaagctattactgtatacagtaattactgcataaagcaaaaataataaaaatgtagtatagcgttaaaaacatttagaagctaaatatatggcaacaataacacaaagtctaagaggagagaaatagaagcatgcttttgtaaaattcttaggctatatgtgaagtagtataactatatgtggtgtggtagtataattatatgtgaaggtagactgtgcaaagtgaaatgtgtatgtagtcatgtgctgtataataacgttttggtcaaaaacaaaccgtgtatacaacagcagttccatcagattataatactgtattttttactgtaccctttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaagggctcaaatcatacaaaatatgttctctaaccacagtgggattaaattagaaatcaacactgaaagacatctggaaacactccaaatatttggaaataagctacagagtgggagaaaatatttgcaagttatctatttgatataaggatttgtatatggaatactaaaactcaaaactcaatgagaaaataacgcttttaaaagatgactgaaagatttgaacacatatttcacccaagaaaatacatgaaaatatgcttaccatcacaggcattagggaaatggaaatttaaaccacagtgaataccgctgcatagctattagaatgtctacaattaaaaagattgaccagctaagcacagtagctcatgcctgtaatcccaacactttgacaggcagaggcaggaggatggcttgagcccagcctggacaacatagggaggagactctgtgtctacaataaaagaaaaagaaaattagccagttgtggtggcctagctgctcacttgggaggatgaggtgggaggattgcttgagcccaggttgaggctgtagtaagctgtgattgcaccactgcactccagcctgcaagacagagcaagaccctgtcccaaagaaaaaaaagattgggctgggcacggtggctcacagctgtaattgcatcactttgggaggctgaggcaggtggatcacttgaggtcaggagttcaagaccagcctgggcaacatggggaaaccccaactctactaaaaatacaaaaaattaattgggcatggtggcacacgcctgtaatcccagctactcgggaggctgaggcccgagaattgcttgaacccaggaaacagaggttgcagtgagccaagattgtaccactgcactccagcctgggtgacagagtgatactctgtctaaaaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaaccataatactggaggctagattacaatagagcaatatcttcaaaattcaaggaaaatggccaggcgcggtggctcacgcttgtaatcccagcactttggaaggccgaggcgggcggagcacgaggtcaggagatccagaccacggtgaaaccctgtctctactaaaaatacaaaaaattagccgggcgtggtggcaggcgcctgtagccccagctactccggagaggctgaggcaggagaatggcatgaacccaggaggtggagcttgcagtgagccaagatcgcgccactgcactccagcctgggcgacagagcaagactctgtctcaaaaaaaaaaaaaaaaaaaaaatcaaggaaaataatatacccagctaaaccatcatgaagtgtgataagaataatgacgaagccagacattttagaaaaatctacccctagcgccctttttctcaagaagccactagaggagtatttcactcaaatgagcaagcagaggaaggaggattgcttgagcccagcctgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcacacatttagtggcttaaaacagctcacatgtattatcttccatttctctgggtcagcttagctgggttctctgcttcagactgcgaaaattgtctcatctgaggcctgggttcctcatcaaagctcatttggcagaattccattccttgaagttgtgggactgagggcccagctttttgctggctgtcagctggaggccacacccaggtcccagaggccatgtgggtttttgccatgagaccttctccttcgtccattcacagcatggcagcttatttcttgaaagccagcaggggggatgggttttctctggaatctgttagatgaagtgacctcccttcactgtcactcgtgccatattctgctggtgagaagcaagtcacaggcctcacctgcactcagggagggactcactgggagtcgccgccacagtgtggctccaggaatggaaactaccacactgcagaggtgcagggaatccccaggattatggtcaagaaagagcccactaagtgttttgttcagtaggcctgcaggatgaagggtgccaggaggatggctccatgaaagactgagcctatacgtgaacgtactgaaagctgacttacagttcagccagtgtggtggtatgtgattgacagcgccctagcaagatgagcaacaaagatacaagactccagcagaaacaagctgcagaagaacaggagtgtaatcaataaatcagatggccttgctgtgaacggttacatagctctgataaatcctgatctaaccaaaagtcatgacagctcgatatttgggagctggagggggtggggagtaggggtagtaggatatgaaggagctaagtccccattgttgatattagaaatccagtgggtaacatctgaacggcaagaccaggacagcagcgaaaggcaaaaagacaccactgagtgttgacagtggctgcctttcaggagtgggaatgccactgggggcagggcagtggggggcagggaacaggtttttctgtttgttttttgtttgtttgtttgttttgttttgagatggagtttcactcttgttgcccaggctggagtgcgatggcatgatctcggctcacagctggagtgcgatggcgtgatctcggctcaccgcaacctccgccccccggattcaagcaattctcctgcttcagcctctcaagtagctaggattacaggcatgcaccaccacgcccagctaattttgtatttttagtagagacggagtttcaccatgttggtcacgctggtctcaaactcccgacctcatgtgatctgcccacctcggcctcccaaagtgctgggattacaggtgtgagccacttcgcctggccatgggaacagtcatgttgcatagtaagccctaaagagcagtgtgatctcttaagccagcacgtgatttactttggtaaaaattaaattaaaaaaaaagaaattaggccaggcgtggtggctcacacctgtaatcccaggactttggagagccgaggtaggcggttcacctaaggtcaggagttcaagaccagcctggccaacgtggtgaaaccccgtctctacttaaaatacaaaaaaaatagctgggcgtggtagtgcacatccataaatcccagccactcgggaggctgaggcaggagaattgcttgaacctgggaggtggagatttcagtgagccgagattgcgccattgcactccagcctggatgacggagtgagactctggcccaaaaaagaaaaaaataatcctattggtctcatagtgtttctctgtatttttaatatactgtgtatgtgcttatgagaaaccgaaagagaagtgatttgtgaacgatttgaggacttttggtccacgtttttttctcccacttatacttgtggcataatccagaggaagaagggcagctgcggagtcccagcagtgttgcgggtatcagggcagccagtgagaggatggaggagaaacccaggagagggcagaggaggagggacagctgtgcccacctggtcctttcattgttgtctgcctctgcccttgcagttagaaaaagagtgttctgtgtatagaagcctttgcaagtagcatagttaggagtctttcggtccaggaattgaaggtgctaaagcaggaggaaaacatacatagaagaaaggaaatgtccacataagtaagtgtattagtctgctagggctgccgtaacaaaagaccatagactgggtggcttcaacaacagaagtttattttattttctcacagttctggaggcgggaagtccaagatcagggtgctggcagggctggtttctgctgaggcctctcttcttggcttgcagacagctgtcttccctgtatgtcgtcttctctgtacacaaacatccctgtgacctcttcctcttcttttaaggacactcagtcctattggattagggccccatgcttatgacctttttgggttgttttttgtgtttgttttgagatggggtcttgctctgtcacccaggatggagtgcagtggcacgatcatggctccctacagcctcgacttcctgtctccaaatgtagtcgtattgggggattaggatgtcaatataggggttttgaggggatgcagttcagtccattatatacagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgcaaaaaaaaaaaaaaaaaaaaaaaaatagccaggcatggtggcacacgccagtaatcccagctacttgggaggctgaggcaggagaattacttgaacctgggaggcagaggttgcagtgagctgagatcttgccactgcaccccagcctgggtgacagagactgtctcaaaaataataatgatttccctgtcttatgtttttctactacacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgagtttccaaacaataaaatatattattaaattgatttgttttccacacgtagtggagattttcatggtgtgctacctgtcggtcaaacggctgatgaatgagtatgtcgcaaaaactctaggtgggaatatgacacatgaggaatggaatttgtgcttcagctcttcccagcatcttcttgggctgcacaagagttggtagtctttcatctcctaaggactgaagggccatttagaatcacacctgttttgagtttatagtcacgcttctgaaactttctctcttacagccttatctgacctcaatcaagctacccctgttcatttaaatactttaggtcttggctattggtttagcttaacatttgattgccataaataagaactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcacaatcaaaaaaaacaaaacaaaagaagtgaaggctgagcgaagtaactcacccagcaagatgcaattcgtatagggtagagtcccctgtctcccgataatgctttgccccacacctgaaagtcttgatctggttcccattacccctcagactttgggtccccagtagaacctttgcacttgcagttctccttcctaatgggctcagggaaactcacatgactgcctggaggctgtttctgcacctgtagatgggaatgggcaagtctctcccgactcacttgtctcatagtgttgttgaaaggctcaggtgtgatcattacagtgaaataaggaaaggcagggaagaatctccatcgttctccaaatacgaagaatgaaatgcaatttttttttttttctttttgagacgaagtctcactcttgtcacccaggctggagtgcagtggtgccatctcggctcactgcaacctctgcctcccaggttcaagcgattctcctgcctcaacctcccgagtagctgagattacaggcacctgccaccatgcccagctaatttgtgtatttttagtagagatggagtttcaccatgttggccaggatggtctcgatttcttgacctcgtgatctgcccacctcggcctctcaaagtgctgggattacaggcgtgagccacagcgcccggccacaaataagtttatacccttgtagtcatggcctttcttttatctttctggtaatgaataaaaatgaagcatataagtgacagagaaaccagctacttgatcaatagtggcattgtttcacaattgtctgtattggattttgccaacccactagagagttaccaaagcacatttctgacataactatgattgatttttttttaatttttgactaaatatgttactttgactaaattggttacttcattgcataatggtgaccatttacacttttcagataggtacaaaaaatctgtgtattctagctggccatgaaagagtagcaagcctgttatttttaagaaaaaagctcgagtagttactgtatttgtatcattttggaaatctctcatttttctaatcagcaaaatggggataatgtaaataacaataaccctgacctcacagggttcttgggattaaatgagatatggtgcatacaacgtgcttagcatggcgcctggagtatggtcagaacttaacaaacacaagttataaatgaggtcccgaaatacaagaaattcacttcctcagaaaccttccttgagcctggctacatctatagctacattttctacatgttaaatgcctccctcagaagtgtcactgttggagttgccagggcaccaatttattactttgaaaatagataaataaaagaatcaagacaaaagaaaaaggtgctaccaaagaagacattctgtcttacactggatcacacgagatgtggatatttggcccggaactgctcacatgggtcagcaagcctgagaatgaccgtggagagaaatggctggggctgcaggactcagccaagcctggcacgcgtgtcttccgggcaccggagcaggacgttgtctgaaaacatgaagaatgaaatggaagtaatgtaatacctggggtcggggctgggggaagctttctaagtacaggcagggtctttctatgttgcccagggtggtcttgaactcctggccccaagcgatcctcccacctcggcttcccaaagtgtggggattgcgagtgtgggccactgtgcctggcctaattactgattttaaatattaatctttctaaaagtcaaactccagaactgtgcatgtagaactattcaatttctgtatataactatagaaatatatattagacgggccgggcgtggtggctcatgcctgtaatcccagcactttgggaggccgaggcgggcagatcacgaggtcaggagatcgagaccatcctggctaacacacggtgaaaccccgtctctactaaaaatacaaaaaattagccaggcgtggtggcgggtgcctgtagtcccagctactcgggaggctgaggcaggagaatcgcttgaacccgggaggtggagcttgcagtgagccgagatcgcgccactgcactccagcctgggtgacagagtgagactccatctcaaagaaaaaaaaaaaaaaatatatatatatatatatatgtatatatttatatatgtatatacacacacacacacattagataagcacattgtttatataggaatcaaaaattacctgtgagtaatttttatttatgtaatttaataattacataaaaattatttgcagaggttacctctggaagcagtattagaagtggaggacttttttcttctatgttgaaaatattttaagtaaatttttaaaaacgaatagaaatttaatcaggaacaggctttctaccattaaaaaactttatagtcttctttacaaaagaagagaaataattgtacttgttcagtcattcaaggccactgaaataattggcatagcttgagctctgtagtactgtcacaatatgcaaacacagtgtggtaatttttatagtaattgaacatgacttacgtcttagaaagtcataagttaggaatttattctgttcgttcttttgaagtgaaaagtaaagaaagcaaaacattttttggccgggcgcgttgtctcacgcctgtaatcccagcactttgggaagccgaggcgggtggatcacctgaggtcaggagtttgagaccagcctggccaacatggcaaaaccccatctctactaaaaattcaaaaattacctggccatggtggtgggtgcctgtaatcccagctactcgggaggctgaagcaggagaatcacttgaggccaggaggcagaggttgcagtgagcagagattgtgctactacacttcagcctgggcgacagagcgagactctgtctcaaaaaaaaaaacaatgactttgacctgaatgtcccaagggtctgctttgtgtagtctgcccctctacaagcagggaccaggtcttggtcacctggtgtccttgtagtaagctcttagcagggactgggtcctggtcacctgggtgtcctggtagtaagctcttagcagggactgggtcctggtcacctgggtgtccttgtagtaagctcttagcaaaggttgctgagtcgaatgaacttcaccgtttcggtcctttggtacagtaacaggcactcaagagagtccacgctgtagggttgatcagccaccatgagagagaagtatactctaagagcacacaccatcaaccccagagcatccctgccgaccaggaatgtagttacagcggtgcaggttcccagctaccccaaagaaatcccaggagagtccatctctactaagtcaagcaaatagaaattgcaactgtagcagcacaatctattttcattatatagtgtgtgtctctctctcccctcatctctctctctctctcctttcccctcggtcacttgacattgatactgggccatttatcctcgtgcatcatcttagagttacatttgtataattatcaacatggccatttgatataaacaattccgtccctcacatccaaagaaaagggaagagacagaaagaaaaggcctaatttctgagcaatttttgttgtttgtttcccattttgtaattgtcctccatctttactcatctgtttttttaaatattaattatttttttgagacagggtctggctctgttgctcaggctggagtacagtggtgcacatggcttactgtagcctcgacctcctgggctcaagagatcctcccacctcagccccctaagtaactgggaccacaattgtgcaccaccacacctggctaatttttgtttgttttttgtagagatggggctttgccatattgcccaggctggtcttgaactcctgggctcaatccatcctcctacctgagcctctcaaagtgtcaggattacaggcgtgaaccaccatgcctgaccaaaaatactttctgagggtctaatattgccaggcaccgtgttaacaattcagaaaatactcctgcttaataaataaagacttgaatttttttagttacttcattgaaaagaaaatctttttatttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggcgtgcggccagaggtcaactcccaacggctgtctgggctcctttttccctgcagtgctgtatgtctgggggggtgacaatcctttgataacagttttttttattgggagaaaatttgtgggaatgcataaggtcttgctaacataattccacattatgcttgctcaacaggagaagttttagtttaaatgtagacttattggagatggctgtatatctgcaggtcagggagtctcgcgtctgcagattctttgtggtttctcgtctgtcgtcgcttatcccaaataagtagctgcacttcttggaagagatgattgcgtcacttgaaggggtcatgggagtctactgattgaactcatttttctcccatctgaaagaaagaaaagttgaaacaagaggaaagacatttcacactttctggcatttaatatttcggctagtttttgtttgtttgtttcttttttgagacagattctctctctgttgcccaggctggagtgcattggtgcactctcggctcactgcaacctctgcctcccgagttcaaacgattctccttcctcggcctcccaagtagctaaaacgacgggtgctcattaccacacccagctaatttttttttttttttttttgtatttgtagaagagacagagtttcgccatgttggccaggctgacttcaagtgatccgcccgcctcggcctcccaaaatgctgggattacaggcatgagccactgcgcccggcctggccaggtttagatcctggttttgtgaaagaatcagaatgactagaagattcatgttccgatccactgcagctaacaaatacagctccaggaaccgcacaaatcctgcatcgcctttcatcagcagatagttaaaggcggagaattgggttttcttgtttgtaaagatagtgcgtgtaaacaagcatgcagtaaattatgttatctgcagtagagtcttccattggtagctttggtcagacgagctgaaatacactgccttcagggttcttcttggtttgtcaccgtgagtagagatttgaatttacactgcctcatctgtactgaattctgcccttgctgtgaatcatgtcacagtctcagaagcagcagcagccatagagtccagtgacatccttaccagtaagatacctttgacctagagagttcatttcaggggtggggcagcatcagtgtggctaaatgtgaatattcatttctttttcttaaactataaaatgcttgttcttttccaaatccatagctaggcacagattatagaggcatcttaaaaagccttctatagctgggtgcagtggctcacgcctgtaatcccagcactttgggaggctgaggcgggtggatcacttgaggtcaggagtttgagaccagcctagccaacatggtcaaaccctgtctctaccaaaaatacaaaaaattagccgggcatggtggcaggtgcctataatcccagctactcgggaggccgaagcaggagaatcgcttgaacccgggaggtggagattgcagtgagccgagatcgtgccactgcactccagcctgggtgagagtgagactctgtctcaaaaacaaaaacctcctataaatgccataagatgccggcaaatgccatctcaaaatgcagttaggcaggaaaattacctggtatgagttgtaacctaggcaactggaaaaaaatatgtgtccaccagttacccttgtgtttgatgtttcaagtagtagaacagtataagtgtggttttctttctggggtctcccccattgtatgcactcactgtagtaaccagaggaaaatgttaccttcctgctgggaaccttaacttccgaggctgtgatacccatcttcatacctaaagttttaacatatagcaagtccccacctacaagcaggtcttatgtcaaaagtgtagttgcagtttattgcctggaacccggaatggattttcccataggcgtgttatgaacggcagctgtattccaggcagctgtggaagcctttttagcccatttatatacctgaagtgcagtcatgtgcaattagcaagacaagaaccagccatcatccatcacaatgttttatgtgttcccccagcctccccactcccactctcagttggcccagctaggcagggaagggggtgttaatgaggcctgcaggtgcacagatttactccccacctgctgcatctgcaggggttaaaccggcttttccctccccttcgctctcaccattccttctctccctctccccacccccagtctccctttccctgtgctgaaggggctgggcagtgaagtgaggaagggtggctggagctgttgggggctgaggccacattgtgcagttcacatcagaaccccctggggacttgctccagttgcagattcaaatgcagcaggtctggggtgggctctgaaattccgaatatctaacaggctcccaggtaatgcccatgcacaggcccacaggccccatttgagtaacaggagtctctaaacaccatgcagggaggagaggctggtgaagagggaaacctcgagtcacgactgaaaggcagtggagggtgagagctgagttctattctctaggccttagggaggtcccttttacactgagaactttttgccacatgggaagaagcaggcaaaccctggatgccatcaggtgctggcacatcgcagcctcatctcatgcaaggtgttcttggccagggcctgtggaggttctacatgatatggcattaaccctcgggagagcaggcacagtagaacctgaatgtctcctccaagcgactgggtgcagcatcgctccatgtgactgggtgcagcatcgccccatgcgactgggtgcagcattgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtacagcatcgttctatgtgactgggtgcagcatcgccccatgtgactgggtgcagcatcgttccatgcgactgggtgcagcatcgttccatgcgactgggtgcagcattgccccatgtgactgggtgcagcatcgttccatgcgactgggtgcagcattgctccatgtgactgggtgcatattgctccatgggcatggtttgtatgaaacactcactattaaagcacagtaggaaatgctgaaatggaaaaggaatgggtcatccgggagccccaggatctagaccctggagcagtgtttcagggcctgaggatccgtcaagggggccagcatcagaagccccagcacacagggggcttctgatgcaggaggagagtgtgcggtttgaagatctttcatcccaacacagcaaggcggtgaagaaccagttttcatcctgtctccaccactaactagccatgtgtccttgagctcataccctcatgcctaagtgtcctctgtcctcatccgtaaagtaaggctaaaatgagtacctacctcattagggtgctgggaagctcaatgagattatttctgtaaaacccttagactgtccattaagtgtcacaaaagcagtcgtaggggtggctgtggcggtatggtagtggtgaaatgagtaatttgagattataggcctaaagtcaaatttctggttttgcaactttttactagtgtgacctgggcaagtgacttagcctctccaaacctcagtttcttcccttgtaaaatggaaataataaaagttcctacctgctatattattgagaggataaaatgaggaaagcacgtagcacagtgcccatcacaaagcaagctctcagtagatatcagttactgttattgagggagaccggggtgacgactggcatctgaacaggagttttccagctgtgctccaggagctataggttttacaaaaatgtgtcttgggggtgagaaggaggccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcaggtaggctgatgtgcttcaactttttctctctttgtttttttccagttcatatcctttttttgtcattttttttttctgataccacagaagtgatctgataaatcctttccttcctttgttactcaaattcctaccaaatgattttccgtgactggagttcactcctgggtgtggctgtgagttacatgctcagatgctcagtacacaacccttagtgtcctgcgctcgagtccagtgaaagccaagttatgtcatccctgaatatagatgtgtttagagcatctctgaccataacagaactctgtaaactcattgttcttttccaggattaaaaccagcgtctgttataattttaaaagagtaacttcctaccttcctgccacgtatctcttggtacagagctagaatcatgtgaaagaggaatcttggtgtatccgtttcctggggctgccatgacaaagtatcgcaaactgggtggcttaaaacagtggaaagtttgaaacagttctggaggctagaagtccaaagtcaaggtgtcagccaggccatacgccacctcgagactctgggtggaatccttgctggcctcttcctagcatccagtggtggctgtcactccctggcgttcccaccttgcagctgcgtcactcccgtctcagcctctgtggtcccaccacgttctccctgtgtctgtgtcttcacatgatgttcacctcttataaggaccccagtcctattggattagggcccaccctaagaacctccttttaacttgattactctgcaaagaccctccttccaaataagatcactctcagccaagcactttgggaggccgaggtgggtggatcacgaagtcaggagttcaagaccagcctggccaagatggtgaaaccccgtctctactaaaaatacgaaaattagctgggcgtgttggtgggcacctgtaatcccagctactcgggaggctgaggcagagaattgcttgaacccgggaggcggaggttgcagtgagctgagattgcgccactgcactccagcctgggcgacagagcaagactctccttctaaaaaaaaaaaaatcactctcacaggtgctcagggttaggacttaagcatatcttttaggggacacagttcaacccagaacactcaactgtgtggcacaacaggtgtgttcggctctcttgtccctggacagacacatagccatgggacagaccatttaactagagggccccatgggttccaggaagggcagggcagcagaaagtaggccacttgatgacttcgggtttgcacagtctcaggttgggctttgactctgagctgtcttaggcagcccagacctggggactctcggtcttattcatgtccacgccacagcactgcagccatacctgctggcttctatcctgactccccatcgtgaagaaaaatgaccacattcctaaacctcttccctgggagacaactcctaatcagaagcttgaaaggctcagggctgcttctcctaccccagggatcaaacatgtcctcaccatattctaaagacacattctttccccgcaagcaccccgcctccttctccccactgactcctgttcctgagcccagaacctctccctcttgccagcatattctcggcctttgcagatgagcttttgtggcctaaagaccttcttcttcaaccatctctgagttacggctccaagccaggcacccaggattctcatttcatttgtttcactaccaggagtccacttgaggacttgttgttgttgttgttgtttgagacagagtctcgcgctatcacctaggctggagttcagtggcgtgatctctgctcactgcaacctccgcctcccgggttcaagcaattctcttgcctcaccctcccaagtagctgggattacaggtgtgtgccaccacgccccgctgatttttgtattttatttatgtatttatttatttgcgacagagtcttactctgttgccaaggctggagtgcagcggcactgtgtgggctcactacaacctctgtctcctgggttcaagcaattctcctgcctcagcctcccaagcagttgggattacaggcgtccaccaccatgcccagctagtttttttatttttagtagagacagggtttcaccatgttggccaggctggtctcgaactcctgacctcaggtgatccacccgcctcagcctcccaaagtgctgagattacaggcgggagccaccacgcccagcctaatttttgtattttaatagagatggggttttaccgtgttggccaggctggtctcaaactcctgacctcaagtgagccacctcgtctggccaagtttttttgttgaggctttgttgctaaaacactaaagacctaggctatggtgagaaagataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaacaaagaaacccataaactcaagtgttgataaaatgttgtttcatcttttggtgtgagcttgtgtgttgccaatgtcttccattccccagtaaggctgtggggaaataattgctatttccccaattgctagttggcctagcaattctctttttatgtcaggaacccattatgttacatttctgccatttgtcatttttctccagaataagtgtgtttgattctcccatctctcttggacagtatttttccagcttttggtgagttttcacatgctctccaagtaggtcatataagtccaattataccttaatcactgtagttaggactcaggtcctactcagggatacatccttagcattattaatgcatacccttaaatcctttattacctactccctaacaagaattcctccagatcttatatacggggcctgcagggcaggacacaggcctatggtaattacttccaatgtatcgggcattgtgctaagcactttgcatgggtggtcacagcacctctggagccaagtgttgtcccataagggccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttatcatatttctgagctttggcaagattcattcaaatgaacacacaataaagtctggcaaatttcctgaagaattcaaggactcccttacttctttattgtactgtgcaaagttacgttgagtacggaatcagattcactccagtcctgctacaaatgtttgttatttacaaaagaattgctttttcttgaattacatacacagaaataagttcaggaaagaaattagtttctttcctaaactggctttagggcatctacagacaaatggttaaagaaaatgtggtatgtatagagagtggaatactacttagccattaaaaaagaatgaaataatgtcatttacagcagcatggatggaagtggaagttattatgtgaaataagctgggcacggaaagactaatgctgcatgttctcactctcatgtggaagctaaaaagcttaccctcatagacagaataaatggtagataccagaggctgggaaggatgggtggctgggaggaggttatgaagaaaggttggttatgggtacaaacatacagttagacgaagaaataagctctaatgtttgatagcaaactaggatgactatactcagcaacaatattttgtatacttcaaagtaacaggaagagagtggggtgtacttgaaatgataccaacatacagtagtaatgataaatactcaagataatggacaccccaggtaccctgacttgatcactacacattccaggcacataataaacactcatatataccccataagaatataaaatattaggccaggtgtggtggctcatgcttctaatctcagcagtttgggagtccgagtgggtggatcacttgagcccaggaattcgagaccagcctgggaaacatggcaaaaccctgtccctactaaaaatagaaaaattagccaggcgtcatggcacgcacctgtaatctcagctactcaggaggctgaggcaggcaaatctcttgaacccaggaggtggaggctgcagtgagctgagatcatgccactgcactctagcctgggtgacagagcaagactcggtctcaaaaatatatataatgtatcaatacaagggaaaaatgggcagaaattttcaatgatatttaataaccataaattaatcttgagttgggttgctgcctgccagcccttctgtgaacatgatttgttcagtcccaagtcacaaaccacagggttacaaagtaccctgggagggtgcctgagctctgtggttttagtcttgaaactttatcttttcacaaagcaattcaaaaattgctcatcaccattgtgttccgagaaaaggggcgccaaggcatcaccctgagccatccgaggagtgctgtgtgccttcttcctttctgcttccaagtaggatggaagctccagctttatacttaaataatcctcatcaacatctaaaagatagtgataattaaatctctcctatctaactaaaatggaatgttttaaagcttaggtaacaattctgaaattcttaattccccccaaaacaaactttttctgagcacattttgatttcttattcccatgccagaatagactgttttgtatatggtatcttccaagatattttcccactgagttaacttctgaaattgcttcttccaacgcataagcaataaacaacagattcgtttttacattctcaccttagctattgcatctctgattgttttcatctataatgagactttctatactttggccagtccttctgtttttcttaaaatgtgggaccacaggccaggcacggtagctcgcatctgtaatcccagcaatttgggaggccgaggcaggcggatcacctgaggtcaggagttcaagaccagcctggccaacatggtgaaaccccatctctactaaaaatacaaaaattagtcgggcatggtggcgggtacctgtaatcccagctacttgggaagctgaaccctgagaattgcttggacccaggaggcgaaggttgcagtgagctgatatcgcatcgctgcactccagtgtgggcaacagagcaagactccatctcaaaaaaaaaaaaaaaaagtgggaccacatactctaagcacctttagacaaaaccacaggatacaaatgtaatgtggctaatcagctggtcttccaccacccacctctggagcatggaaggccttgtccagccttgccttgccaagccaagggtcatctctagtccactgagcccaccctctaccctagcacccctcctgtcccaagagtcattgaccctcaggtcaagggataccagagccactacagtgaggctggccgtgtctctgaaatattttctttttttttttttgcccttctctcttcctcggcgctgcctatggaggtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaagaaagaaatattttctttcttttctttttttttttttttttgagacgcagtctcgctctgtcacccaggctgaagtgcagtggcacgatctcggctcactgcaagctccgcctcccgggttcacgccattctcctgcctcaacctccagagtagctgggactacaggcacctgccaccacgcccagctaatttttttgtatttttttaatagacacggggtttcaccgtgttagacaggatggtcttgatctcctgacctcgtgatccacccgtgagccaccgcgcctggcctgaaatattttatttttgttcatctttgttgtgcttataatactcctgttttctgtttattcccctgacttgaaccagatgttaggggagtatttgaagctcctcgttccctctcttcatcaatatcttctgtctagaaactaaccaagcaccttatctggctccagacctctcagtgatctgtgggaggccaactcgcaggatttcagcagagtttgcactttctaggcctaaaagataagtccttccatgtgtaagttcagattaaaggcaacatattgcatttacattttagagaggtgaacacattattttctgggacttaagtgttgttttgtttcttttttttttttttaatgtagtttatttctctttctaagagattacaggattcaagaatggcaatgaatcttaatagcctttgggagaaagcagcaaagctttaatactaagttccaggaccatgaacttccatgttgtcctaaatgcatttttcaaacattgctttctgtgcctactctataaaacctaaaaatccaaggtgacagtattccttatctaaaatcctaaacaaggctgggcgtggtggttcatacctgtaatcccagcactttgggaggacaaggcaggcggatcacttgagcccaggagttcaagaccagcctggccaacgtggtgaaacctcgtctttactaaaaatacaaaaattagccgggcatggtggtgcacacttgtaatcccagctactccggaggctgtggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 401 - DNA, 236210 bp, Homo sapiens; identical to SEQ ID NO: 400

SEQ ID NO: 402 - DNA, 235556 bp, Homo sapiens
cacgtgcgcagccggccgccggctctgatgcaatcgcgccgggcgcgacccagacggtaaaggggcggtgcggctggggcggaaaccaggggagggggcgaggagcaggaggagggcggggctgcggctcggcgcgccggctggcccggggttcgggaagggcaagcggagctcgggagaggcgggctcgggcccagcgccgcccgcgcgaagctccctggtgttgtgcgcccttccccgcgcgcggcccctcctgctgggctggggtctgtggctgacgtccgcttttcccggaacggcaaaggtggagccgggcccccgggacagccgccggggggaatccgagaggtctcagcgctggtttccagcttcgccgcgcagcgcccacggagtccccgcgcagctgggtttgcagggttttctgcgggcccagagcgaactgggagccccgggcccggcctttcccgtcccggtccccgcccctgggctccagccttccccgccctcgcccagaggggcgcacgggtctcgggccttgcagggcgagcccttcgggacaacttgggggtggcaagaaagccccttccgcctccctcggaactgggattaggaacgagttccaggatgcggtttccccggccagcggaccacctcctccattcacatcctcttccctttccttctagccttctttcttagtcattgcctgcttgcctttctctctgcctttccttcctccctctgctctcccattttcctccccactccccttctcccatctcagtaaaatacgtttcctaggctctttattatgtggcggatgattttaaggggccatttatttagtttttcttgttctctgtcttctttttcttttagaaatggagtctcgctttgttgctcaggctggagttcagtggtgccatctcggctcaatgcagcctccgcctcctgggctcaagcgattctcccgccttagcctccagtgtaactgggaccacaggtgtgcgctaccatgcccggattattttattttattttcatagagacagagcaccactctgttaccaggctggtctggaactcctgggcgcaagccatcatccctgcccccaaaagcgctgggattaattacacgtcaggtcattaggttttaacctgcacgttgctgagactcatcttaccggttagagtctgaagccaggataggcggcaaaaaaacttctcccgtcatgctgttttattttctaggtaaactgattattacctgaaacttccttctttgctcatttcttgtctgtctcacccacctggaatatgagcttcatgagacagccgtctcttcggtgctatatcctaggtcctggagagagtgcccagcatgtaataagcacttgtgaaatggttacagaaggaatgcttcaagatttggggtcatctgtgggttttattcatacatattctttttttttttttttttttttgagacggagtcttgctctgtcactcaggctggagtgcaatggcacgatcttggctccctgcaacctctgcctcccaggttcaggcgattcccctgcctcagcctcccgagtagctgggattacaggagcacgccaccacgcccggctaatttttgtattttgagtaaagacaggatgtctcaccatgttggccaggctggtcttgaactcctgacctcaggtgatccgactgccttggcctcccaaagtgttgggattacaggcgtgacccaccgcgcctgggctattcatgcatacttttaggtttaaagccatgactgccttagagatgagtaaagaggttagtagggggctttagggcctgcactgggttctccaaactcaattccttcaggaaaatgggaggagtaacagtacttacctcaaggggttatggaaacaattatgtgagaggacacatgcaaaatacatagcccaggactgtcacatacaagacaagtccctcaacaaatggtggctattaattttttttttttttttttgagacggaatctcactctgtcgcacaggttggagtgcagtggcgggatctcggctcactgcaacctccgcctcccgggttcaagcgattcccctgcctcagcctcctgagtagctgggattacaggctcgcactaccacgcctggcttattttgtgtttttagtagagacggggtttcaccatgttggccaggctggtctcaaactcctgacctcgtgatctgcctgcctcagcctcccaaagtgctgggattacaggtgtgagctaccatgcccagcaatatttttacaattcactaagccaggggtccacagacgttttatatataatgggccagatagtaaatattttaggtttagtgatcctagaggcaaatcaaaattattagtaggtacatttataacaagagaaaagacaaatttaggccaggcaccatggttcatgcctgtaatcccagcactttgagaggccaaagtgggatgatcacattcccaggagttcaagaccagcctgggcaacatagtgagacacccatctctgtaaaaaattttaaaaaattaactgggcgtggcgcgtgcctgtagttccagctactcagaaggctgaggcaggaggatcacttgagcccaggaggtcaaggctacagtgagcggagattgcgctactgcactgcagcctgggcaatggagtgagaccttattttttatttttgcaattaagtatttttaattaaggtatgtacattttttagacaatgcttttgcacacttaatagatggcagtatagggtaaccataacttttatttttattttctattttactttaagttctgggaaacgtgccgaacgtgcaggtttgttacataggtatacatgcgccatggtggtttgctgcacccatcaacccgtcatctaggttttaagccccacatgcattaggtatttgtcctaatgctctccctcctcttgccctcccaccccctgacagaccctggtgtgtgatgttcccctccctgggtccacgtgttcttattgttcaactcccacttatgagtgagaacatggggtgtttggtttctgttcctgtgttggtttgctgaggatgatggtttccagcttcttccatgtccctgcagaggacatgaactcatgctttcttatggctgcaattttatttttgtagagatgaagtctcactatgttggccaggctggtctcaaactcctgggttcaagtgatcctgctgcctcagcctcccaaagtgctgagattgcaggcatgagccaccacgcctggctatattgtacctttcaattgagttatgtgcatggtttactgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaaatacaaaaattagccaggcatggtggtgtgcgcctgtagtcctggccacttgggaggctgaggcaggagaatcgctttaacccgggaggtggaggttgtggggaggcggaggttgtggtaagccactacactccagcctgggaaacagagcgagactccgtctcaaaacaaaacaaaacaaaaaaacccaaaaaacatatatatatatattatatatataaaatatatataatataatataccttaattataatataatataattatatataccttaatttatatatataccttataatatatataccttaatatatataccttaattatatatatacacaccttaatatatatataatatatattaatatatatcttaatatatatatataaggtaatatatatatacaccttaataataatatatataccttaattttaaaatactttattaccaagaaatgccagtgatctggtggaggatttgcctagatgttgatggttattgactgatcagggtgattgctaaagattagggtggctgtggcagttttttaaagtaagacaatgaggtttgctgtattgatggaactcttcctttcctggaagatttctctgtagcagtgctacagagaaaatggtaacattttacccacagtagtaggacttctttcaaaatgggcgtcaatcctctcaaaccctgcaactgctttaccaagtacttgatatcaactactgtaatcttttttttttttttttttttttttgagatggaatcttgctctgtcgcccaggctggactgcagtgctgcgatctcggctcgctggaacctccgcctctcaggttcaagtgattctcctgcctcagcctcctgagtagctgagactacaggcgcctgccaccacgcctggctaatttttttgtatttttagtagaaacggggtttcaccatattggccaggctggtctcgaactcctgaccttgtgatccgcccacttcggcctcccaaactgctgggattacaggtgtgagccactgtgcctgcctaactactgtaatcttataaatcctttgttgtcattttattttattttaattttattttattttattttaatttaattttattttattttattttttgagacagtctcactctttcacccaggctggagtgcagtggcgcgatctctgctcactgcaacctctgcctcccgggttcaataaattctcctgcttcagcctcccgagtagctgggattataggcgtgcaccaccatgccctgctaatttttttatttttagtagagacggggtttcactatgttggccaggctggtctccaactcctgacctcgtgatccgcccgcctcggcctcccaaagtgctgggattacaggtgtgagccactgcgcccggcctaataaggctgttttcttatcatttgtgtatccacgggagtagcacttttaaatttcttcaatagcttttcctttgcattcacagcttggctaactgtttggctcaagaggcctagcttttgacctatcttggctttcaatacaccctcctcactaagtttaattatttctcggtttttatttaaagtgagagacctgcaactcttcacttgaacacttagaggccactgtagttactaattgtcctaatttcaatattgttgtttctcagggaatagggaagccagaggagagggagagagaagggggaacagccagtccagtgaagcagtgagaacacacaccatcatgaaccatcatggccacggtttggccaacacaattacaacagtaacatcaaagatcgtcaatcacacatcaccagaacaaacatactaaaaatgaaaaagtttgaaatattgtaagaattatcaaaatgtgacacaaattgagcagatgccattggaaaaatgactcccatagacttaaaacacaggttgccacaaactttcaatttgtagaaaaacacagtatctgtaaattgcagtaaagcaaagcacaaaaaatgatgtatgcctgtatttttttttctatccacatccaccccccaactttttttttttttttggtagagaccaggtcttgctatcttgcccaggctggccttgaactcctgagctcaagtgatcctctcacctcagcctcccaaagtgctgggattacaggcatgagccactgcgcccagcccccatccccaactattttaaaagtctaattactttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccacactccggtgctttcctggacccagacaaaaataagaacccagcatagccaaattaacagtcacgacaggctggaaagagtgcggtatatgggcctcagtcacccattattggatggatggattttagtgcttatttataaggtgatttgtaaactttcccatatggtcacatttattcagcacaataatacaattaattccctgggaatgaagtagctttatcccaagtgtttccaaacaaaactaactgaaatgttcccaggttatagacagttgcctgcacccagtccatctgttccggcccagctggcagtagaaagactggtcctggttgtgaatctgagcagctctctcccctaaagccccgcctgggaactgcagtgcctctggttccatttgtcagctgtgtctctctgaaaactggggaaagcttcccgatgcctttctgctcttggcagtgtaccgttgatggcattggctggaacttcttcaccccgcatttttgttaggtgcagtgcaagaccctgtcggagactgaaaacaaaatgtaaaggtggtcttagcactgaagcctgggggctcctgtggctgcgcctttggtctattgtgagagggggaaaagccagctcccagtgctcatgtgctgctgagaacatatcatagggtggtggcgaaggtagcctctgcagtcactcatcccagaaggttccataaagagctgagctcctaacacttttttttttttttgagacggagtcttgctgtgttgcccaggctggagtgcggtggcacaatctcggctcactgcaacctctgcctcccaggttcaagagattctcccgagtagctcagattataggcgcctgccaccacacccagctaatttttgtatttctggtagagacggggtttcaccatattggccacggtggtcttgaactcctgaccttgtgatccacccgcctcagcttcccaaagtgctgggattacaggcgtgagccaccgctcctggactttttttttttttctttttttaaaaagaaattgagtcttgctctgccacccaggctggagtgcagtggtgcagtcatagcttactacagcctcaaactcatgggctcaagcggtcctccagcttcagcctcccaagtatctgggactacagtcacgtgccatcacgcccagctaaattgtttatagagatgggatctcgttatgttacccaggctggtctcaaactcctggtctcaagcagtcctaccgccttggcctctcaaagtgctgggactacaggtgcatgccaccatgccaggccttctaccacttttacctaggcctgctcaccccaggctggcacctccctcagaggtgggaggtgaaggtggctgctgctgggcatttaggaggtacaggtgcagactatgttgtggattctcagaggactgagaagctctctgtctctctctctaggaggctttgatagtgttatcaaagtgggtctccagtgtttctggaactttcctccccttccttccttacctaattccttctttaaattccaggacctggaatttatcctgtctcgacacttcttgtccaacagtgagccccctgtcttcacccccctaatcccctgtcttcacatccctcttcccactttatttgctttccccatggacccatactcagggttttgggaggatggcagcggagtatggtggaggagagcgattatttaaagtagaaacccaaagcttttattatagtaaacttggaaaatacaagagaaaaattcacccctagaaaattattgtaaacatctagtttgtttccctctgcatattttaaaaactggattgccgcattttaccttgtgttagtgtcttgatttcattgttacgccgcctaccccctccacagtgtacacttggagtgcgtccttctgtggtctagttattttcacttggaggaaggaactttcacagaaaatgtgttgtgtcagtcctttctactcattaaccaagaaatcacaatgttgttttctttctcaatgtagagaagtcattcagaattcaaaagaagttctaagtttattgcaagaaaaaaaccctgccttcaagccggttcttgcaattatccaggtaagccgagaacaaggttcagtcctactattttaggatgcctttcaatttagaaaatgattgtatacaaaagagcagctgcatttcttgccaaagaggagagggctcagttggcaatgctgttttctttggtcttttgcttctttggggtcacgggtgaagtactgccctgcttgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaataggagggatattattttccttaaaaaagtgacataatttgaaggcctgaggaattactctgttaaatactggccccaagtccctttttataagcagcaagattgtttttctgcaccttccatattatctttgtaattagatcatctgtaatcacaaaattcatctctggattatcttttgtgccttttcaagctatttttatgttgttatgttgtttttaccttcctaaggcaggtgacgacaacttgatgcaggaaatcaaccagaatttggctgaggaggtgaggactgctgcttttaaaaaattcactataacttttaacaatacattctcttatagtgacgaataaccttgtgttcctttttcaggctggtctgaacatcactcacatttgcctccctccagatagcagtgaagccgaggtaataatggcagagctctaaactcttgcttcttctttcctcttgagacttaataggcccattggcgtctcttagtggtggctgggacagatctaagatttgcttgtgactgaatgttagagggaagacttcacttcttttctctagggtaaatgcttcatgatatccttgtttcttgtcatttgtatgtttctactgaagacttgagttgcgacttgttgagttcggttgtgtttcttcagctgcggtggcagcgtcatctagtggaaattgtcaggccgaggcgaggaaactggaccttggaccacagatccctgtgccagggcccggcccttctgtggttagcttttcttcctactggcttcatgtgacagaaaacctcaaataatggaatcttaaataatgtacaagtttatttctctctctctctctttttttttttgagatggaattttacttttgttgcccaggctggagtgcaatggtgccatctcggctcactgcaacctccgcctcccaggttcaagcaattctcctgcctcagcctcctgagtagctgagattacaggtgcgtgccaccacgcctggctaatttttgtatctttagtagagatggggtttcaccattttggccaggctggtcttgaactcctgacctcaagtgatccaccctccttggcctcccaaagtgctgggattacaagtgtgagctactgtgcccggcctagaagtgtatttttctgggacatgaataaagtttggaagtaggcagtccctggttggtgatatcaccaagtcgcaggagctcaggctcctgtccctctgctctgccgcctttgtggtttggttaacaagcactttgttctgattgatcagtgaggcccagcaggtctgctagtcatttgtgagacaaagaatgggaatttgtagagtttgtatctggccttgtgctatgtaaacaagggggcattggtgagtcttatttgagtcctatggagaagagcagttctttgcagtacacagaggctgcagggatttgttaaccttccctcttttccaggatcacagggctcaggtaaagttcgttgtcaccaagaagaaaaaggaaggacaaagacaggcccctgctgtctttaaagacatttcctgaaagtcacagttctacatccatcccgttgtcccctacttagttgcctggccaactgcaaaggaggctgggaagtgtagtttttataccaggaagccttagatcatttattagcaagctaaaaaccaagagtttattactaagaagagaaaggaaactatatactgggcgataagtgtttgccacacttgccattgtagcgtggtacaaatatgaagtgttaaatatgtaacaaatacctatgataccagcagtgacagcatgcaaaggaagttgttgttcatttgcacgatacccactgtctgcagcagaatttgcttttctttctttttttttgagatggagtctcgctctgtcaggctggagtgcggtggtgcaatcttggctcactgcaacctctacctcccgggttcaagtcattctcctgcctcagcctcccaagtagctgggattacaggcgcccgccaccatgcctggctaattttttgtgtttttagtagagacagggtttcatcatgttgaccaggctggtcttgaactcctgacctcaggtgatggcctgcctctgcctcccaaagtgctaggattacaggtgtgagccactgcgcccagctggaatttgcttttctttaggttgttttgccactggtgtttttttttttttttttttttctgagacggagtctcactctgtcacccaggctagagtccaatggcgcaatctcctctcactgcaacttccacctcccatgttcaagtgattctccctgctcagcctcccaagtaactgggtttacaggcacccgccattatgcccagctaatttttgcatttttgtagagacggggtttcaccatgttagccaggccgttctcgaactcctgacctcaggtgatctgccctccctggcctcccaaagcgctgggattacaggtatgagccacctcacctggccttgacactggtattaatagcccttgattttcgtcgttgttgtttataattgacacataataattgtgcatgtgtgtggggtacagtgtggtgtttcggtacttgcatatgttgtgtaatgatcaaatcaggttagttacattcatcacctagaacgtttatcatttctttgtggtgatagctttcaagatcttttctagctgtctggaaatatacaatacattgtcattagctttagtcactctactatgtaagagaacactggaatttattcctcctatctaagtgtaactttatacctactgatggaccaacctctccccatttcccctcccccatccctctccagcctctggtaaccaccattctattctctatttctatgagatcagctttcctagattgcacatgtaagtgacatcctatgatatttgcctttctgcacctggcttatttcacttcatgttatgtcctccaggttcatccatgttgccacaaatgacaggatttcattcctttttatggttgaatgatactccattgtgtatacacaccacactttctttatcctccattaatgggcatttggattggttccatctcttggctactgtgaatagtgctgtaacaaacatgggaatgcagacggcttctcagcatagcggtttcagttcccatgcgtatatacctagtggtgggaatggctgggtcatatggtagttgtttttttaattttgtgagaaatcttcatactgttttctctaatggctatattaatctgcattcccaccaacagtgtacaagagctcccctttccacatatcctcgccagcatttgttattgtcatttttgataatagccattctagcttgatatctcattgtggttttgatttgcatttccctgataattaatgatgttgagtgttttgtcatatacctgcaggccatttgtatgtcctttgggagatgtctgttcacgtcttttgcacattttttatttgaattatttgtttttttgttattaagttatttgagttccttatatattctggatgttaaccccttgtcggacgcatactttgcaaatattttctcccattctgtaggttgtctctgctttgttgattgtttgctttgctatgaagaatgtttttagtttgatataatcccactgatgtatttttgctttcgttgcctattttgttgaggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattatagatgaaatcttaaagatcaatgaagataccagagtacatggccttgcccttcagatctctgagaacttgtttagcaacaaagtcctcaatgccttgaaaccagaaaaagatgtggatgggtaagaaaataaaatcaaataatcaacctttatggctaaatcactttttctattgtgcctgcttttatttttctaaatttcttctatttatttcaactgtgtcagtaattggataaaaaaatcattttaaatatttcaggagtctataggatttttttttttttgagatggagtctcgctctgttgcccaggctagagtgcagtggcgtgatcttggctcaccacaacctccatctcctgggttcaagcgattttcctgcctcagcctcctgagtagctgggattacaggcatgcgctaccatgcctggctaatttttgtatttttagtagagacggggttttaccatgttggccaggatggtgtctatctcctgaccttgtgatccactcacctcagcctcccaaaatgttgggattacaggcgtgagccaccgtgtctggccatctgtagccttttaaaattctgcatgcaaaagttacatattttggaaaatacattagcccttttatagtgcttcaatgccatatgatcttacaccatcagattcatttaataaattccggtctgacttatacaatctttagccagctctattcttctaatagttttttccttggtaattctaccagaccagagaagaaaacttagaaacctgattccccagcagtaccatattctgtcttagtcccaggccagttgagaaaagcaaaataaatacttttcttaatgacacaaggttttatttgaaatttggaggggaacatcataactattgggtgctgtaatgttggcctgtgattcatgtcatggagtgacataagcttcatagaacaaaggataccggccgtctccagtgggggataagcatgcttcctggggattaaaaccccattttcctccatggaaatataggaagtgttttgtactgtggccaaaaagaacacaatgtgttaatggttataggttgtaagcagatttataaagttagattccagatccggtagaccctgcaggggctggatggggaggctaccaccttcctgagacacccagcaatcttccattctagccttttattgtgacttgagtagacccaaacacaggctgaaaaggtgtcatgaacacctccagtcctggctgggcacagtggctcacacctgtaatcctagcactttgggaggccaaggcaggaggatctcttgatctcaggaggtcaagaccagcctggacaacatagtgagacctcatctctattttttttttttttttttgagacagagtctcactctgttgcccaggctggagtgcagtgacacgatctcggctcactgcaagctctgcctcctgggttcacaccattctcctgcctcagcctcccgagtagctgggactacaggtgcccaccaccacacctggctaatttttgtacttttagtagagacgaggtttcaccgtgttagccaggatggtctcgatctcctgacctcgtgacccgcctgcctcggcctcccaaagtgctgggattacaggagtgagccaccgcgcctggccccttgtctctatttttaagtaaataattaaacatttttttaaaaaacgacaatctccagtcctgtcgtagactaactgtaaaaggagaagaagcactaatccatgagaaaactttcagaacttgaaggtcctagggcatagtttcaagtctttcataaaaggaggggaattcatgctgaggcccagccaggaaaaaccaaccaaacaaaaacaacagagagtaaaaggagaaattacgaaaatggttctaaatgtctccattctgttactgagattgacgtgctcagtttaggctagatagctgtggaatgttttgtcctagatttgaacagggaaaggcacagaacccttcagaagtgtgtggtcactcattttttccactgccccccaccccgacttctcaaggagataaatatcgaggtcaagttgaaatcagacctgtgacctgtgcctcaatcccaggtcttactgggtcactccagatttataggattggttctgggttttgagtggactgcaggaccatgcttctgtgtaactctagggatgctagtccattggggtccattgaaaggagctccctggagttgcgaagtgaagccctgtatggctttaggctgtgtcctggtatattggcagaaccggaacacccaatgtcagggccagggtgaagtttcctaaggtactgccttagaattttctaagacctttattgaatggcctttattgcctgctttctctttaattcattttttatgggtttttttttttttttgagatggagtctcgctctgttgcccaggctggagtgcagtggcatgatctcaactcactgcaacctctgcctcccaggttcaagcgatcctcctgcctcagccccctagtagctgggattacaggcacgtgccatcacgcccagctaccttttgtatttttagtggagttgaggtttcgccatgttggccaggctagtctcgagctcctgacctcatgtgatccacccgcctcagcctcccaaaatgctgggattacaggcgtgagccaccatgcctggtcctctttaattcatttttatgtattctgtctatcaaacattgacttggatgttatttggggttaatatatgtacattacacgtgagtgatttttttggctgggctttgacttaacctacttctttattttctgattcagagtaacagacataaacctggggaagctggtgcgaggggatgcccatgaatgttttgtttcacctgttgccaaagctgtaattgaacttcttgaaaaatcaggtaggatgctccttgagaaatgccgctgatttctatttattggtatttacattatttttaataaggatttgtttggggaagaattaaaaatttttttaaattattattctgatatccttttaggatgtttctagaagattctaattgaacatagaagtgatatttcacgttgactttttttatttttctcatcttttgggagatacagatgaatacctagaaactttttctagtaagaccatcttataaattaaaagagaaattagtagagataaacgattagccctgttttaaacatgctcaatttctctcatgaaacagtcaaaataaccacagtaaaatatgcttccagtttcagcttactaaatctatcaatatgtagccttagataagacttacgttgaagacttaaatgaggccaggcacagcggctcatgcctataatctcagtgctaggcgaggccaaggccagaggatcacttcaggccaggagttcgagaccagcctgggcaaacatactgagaccttgtctctacaaaaaaaatttaaaaattagctgggtatggtggtgtgcacgtgtagtcccagctatgctggaggctcaggcgggaagatcgcttgagcccaggagtttgaggttacagtgagctgtgattgcaccactgcactctagcctgggcaatatagcaagaccctgcctcaaaaaaaaaaaaaaaaaaaaaaagagaagaagaagaagccggtagatgtagtttagggcacaggagcctaggttgggatttattggtgagcagcttgcttttcagtagtcaggacttaatttccattgttgtccccttgacttggcgtttttatgtcagtgaaatagaaatgaatattttctctttcttcattattaagtttaatgagtaaattactaccaagtatttatatatttaagggctttctgagaacataaagattcaactaattgggccggcacagtagctcacacctgtaatcccagcactttgtggagccaagatgggaggattgcttgagcccaggagtttgagaccagcttggggaacatagggagactccatctctaccaaaaaaaattttttttttaattagccaggtgtggtgacttgtgcctgtagtcccggctacttgggaggctgaggtaggagaatggctggagcctgggaggtcaaggcttcagtgagctgtgatcacaccgcagcattccatcctgggcaacaagcaagatcctatctgaaaaaaaaaaaaaaagaaaagaaaaaattcaacgaactaaatctttttctctactccagtttgaatagaaatgaagcaaatgcccctccctacccctgaacatccaacaatcaaagaaaaatttcaaaaatatatggcaaagttttattaaaaggttaacattcaggatatatatgctttttggacagtaatattaagctcaaatctatgaaataatccatatatacagtgctttttcattacgtggattatcaagatgaagattctgagccacttcattagaaagtactcaaagaaaagagtaaattaggctggtgagttatagttacatattgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattctcaccatagtaagtacagaacagtcatttggtaaatctaatatgcattatgaccttttgaaagtaattataattttgatgaaaattattaagaagacccatataaaagcagaggtatcatcttcatggagaagatgcaatatcttaaagatactaattgtctgcaaattttgtagaatttgacagtctgattctgaaatccaaatggaagcataaaggacaaagagagtcaagacaattttgtggaaaaactaggtgggagacattcccagccacacagtgtgaattattatgcacttacagtaattaggataatatggtagacaaacagacgatcggaacagaagaaagtggaaatttatgcatatatggaagcttgagagcaggtaccacagatcagtggggaaaagattaactattaaaggccgggcgtggtggctcatgcctgtaatcccagcactctgggaggctgaggcgggcaaatcacttgagctcaggagtttcagaccagcctggccaatatggtgaaacaccgtctctactaaaaatacaaaaaaattagccgggcgtgtcggcgcaagcctgtaatcccagctactcgggaagctgaggcaggagaatcgcttgaacccgggaggcaggggttgcagtgagccgcgatcgtgccactgcactccagcctgcgcgacagagtgagactccgtctcaaaaaaaaaagctaaaacattaactattaaaaatggtgctgacttaactagttatgtatatgagtctagcataggattactaacctgccactacatataaaaatcacttctatattaaaatacctaaatgtggaaagcaaaactgtaaaacttatagaaaaaaatataggcgtatgcatttaagaggttggcgttggaaggatagcttaagagaccccaaaagcacagattgctaaagaaaaggtatataaatctgactgcatccaaatttttaaaaaccccaaagtttttctttctgaaaagaagttcttaaaaaagtgaaaagacagctatagtgtagaagatatttacaacaaacatttagccaataattagtgtcttataaaagattcctacaaatcagtgagacaaagacaatctgttagaaaaatggacacatgacagaccactaacaggtgaggaacccgaggtttaaaagacacgtgaaaagctgtctggtttcctgctgtttttgctcaccagtcatattggcagtaggtaaaaagtgccagttagccatattgacaaatgtctggagctatgggaattcatatattgctggcgggagtttaaatttgaaataggcatttcggaaagcagtttaatggagtttgagctactctttgacccaggaatttcactctaaatatatatgatatggccaggcatgatagctcacccctgtaattccagcactttgggaggctgaggcaggcagaccacctgaggttggggtttcaagaccagcccgaccaacatggagaaaccccatctctactaaaaatataaaattagctggatgtggtggcacatgcctgtaatcccagctattcaggaggctgaggcaggagaattgcttgaacccgggaggcagaggttgcggtgagccgagatcacaccattgtactccagcctgggcaacaagaacgaaactccgtctcaaaaaaataataataaaaagtgtatatatatgtgtgtgtgtatatatatatataatagacaaaacttgcccatatatatacaaaggtgtgtttacaaatggtcagagcagcatgtttatagtgcaaaaagttttgtttgtttgtttaagacagaggggcagtggtggttctgtgggtcttggcccctttctgctgtcagggctgagttggctccatgagttggtgaaagcggtatctagccaggttcaagggagacaggggcaggatttcgccttcactgatgggcaggccagcggtcccctgtggaacggtgactattgaatattgagaggacagtatccctccctgagcatcttctggagcttgatgaccactagggaatgtatctgagtcacgcgcaccaaatgtgttaccggtggcagctattcgagttatcccgagttcgtgctggtgtatccgtacagttctgcagcaacttcagctcttgcctcctcggaagaaagaattggactgagggccataaggcagaaggagagactgaggcaagtttcagagcaggacggaaagtctagcaaaaagctctagaacagtaaggaaaggaaagaaggaaagtataacttggaagagagccaagcaggcgacttgaaaaaccaagtgcactgcaacaagtatttaaacagtgatctaaatgcccatcagggtgaaaggataaatcagtatagttgcatgtagagtatgcatagtcatagttcataaaacaatgatatacaagcagtgaaaattaataaactagagctgtagatagcaacatgttttcttgttttgttttttgtttgtttgtttttttgagacgaagtctccctctatcccccaggctgcagtgcagtggcgcgaactcggctcactgcaacctctgtctcctgggttcaagtgattcttctgcctcagcctcctgagtagctgggactacaggtgtgcgccaccatgcccagctaatttttgtatttttagtagagacagggtttcaccatgttggccaggctggtctggaactcctgacctcaggtgatccgcccacctcgacctcccaaaatgctgagattacaggcatgagctaccgcgcccgggctggaagaattttttaaaacactgttcagtgaacaaaaacccaagttgcagaaggatgtatttcatacaacaccatttatatgtgtctgaaagcaacacaacatatatatatatatgtaatctaatacatacatacatataatatgtattacatataatccttatatatatatagaatcttaatatatatatttaggtcaggacatttagatcactgtttaatatatatattaggattatatataatatatattatattattatgtattaattatataatccttatatatatattaggattccatgcaaatgaagtaaaaatataaagaaataatgcaaactacgaaccaaatccgaaaagcatttattgaggcaaggatgtggatatagatggaaaggaaacctagacaccttcatgccttttttcttaaactgggcaataggtgttgtctaggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaataaaccgtgccctgcactgaacagctgtggtgaagagagaaaataccttccttggcaattgaatgttttcgcagctgtcacagatacttttgctagttgtatctatatttttgaaaaacaaagacatttttcaaagtacttttttattacgggaataaatcaccttgtctctgtactttgggatgaatctcatctgaactttgagaacgattaagtggcttcactttctggagaatctggtcattgggtaacattcttgttttcatatggaccagaaggttctctttcatagttgatgttgcacacacgtttttttccctaagtccttggtatttatagtggcaccattgcgaatgttagaggctatcaactttcattcttattattgcttcatctttgtagccaaaaatatgggaagaaatgttcatagccccgccccatacttgtccccctctacctggcctacctacctacgtcaggctcctgtcccaccacaaatgacagcctgtgtctttcatgttagcagctagtctttcactagccacatacttccccgtaacccatatgcctccctgtgtctgcctgacgtttgaattgtcactattctgttgttgtatttttacaagaagaatgtatggggcagaaaacccttgccattcatttcctgagtaggaattctagccttccttggagtcgtggtaatatggagacatggtaatatgtggattgtaccactcaatggctgtctggaggccacagtggtgcaaaaagccacctaggcatgggttagtgtcctggggcacccaatcaggacaggacacctggcacacccttggaaaagcttcactgtgaaaaacactggaagtaaaaattttaacaacagatagggatttttttccccttgagacagaggctcactctgttacccaggctggagtgcagtggcgcgatctcggctcactaaagcctctgcctcatgggttcaagagattctcatgcctcagccacctgagtagctgggattacaggcgagcaccaccatgcctggctaatttttatatttttagtagagatggagtttcgccatgttggccaggctggtctcgaactcctgacctcaagtgatccacccacatggccctctcaaagtgctggaattagaggcctgagtcactgtgcctggcccacatggggatttttgttgcccagcttaatcaaccaagaataaaagtgcattttaagattataatctatttaacttctccttattggcaatggtaaaagagttaaggaaaaaagagaataagcttaggattatggctactaagtagaaggacgttatctttgacgggcatttctgttgtgcttatttgtacctgacatggaacaagacccccccatcccctcaacacatacctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggagatccctgatgggccagttactactttcaggctctgtaggtttaaagaatggttatatccagttagttacaaatagaaatcgatcctttctctgtccgtctgtctaaacggaaggatattctgtggacgctgattaggtataaaatctccacggagcctgagcatgaagaattgaccttcttagggttccacagaaaccagaatagacttctgtgtttggtagctttgtaacttacgcccgttgaggtgtacggttgaaaattgagaataaatttcctgttctgtttctgagcatcttttccaggcttggagatgcgttgagcatttccacggagaccctagaggtggggaggggaagaacgcctgggcatttgtccaaattagccatatgctgtggagtgtcacatgtcaggaagccaaggcactggagctagtgtttttgggcagggctagggaaccccccgcctttcctccacccaaacgcaggcccccacacccagcgtcctgggccctgcaggggaatgacactgttggtttcactctcaggaatgagcctagatttggaggtaacctcttcctgaccccgatgatttcactctgatgccaaaaccagtctgaagtgggtgtggttttgcatttggtgtttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaaaaaatataggtctttcacctttgaaggatcaaagtgtctagggttttttgtggttttttttttttttttttgaacaaagctgaactattacaaagtccttttcagtttaaatttagtgcatggcatggctcatgaaagacttttaaaagtgaattggaaaattctaaatgtacttgtattatacatgtgaaaggatgacttcttaaaaaaagaataatgtctgtcccaaacgggagaaggaaggaactctagcttttaaactgcactacattagtgagttacatgacaattctccttttaacaggatggaatgcacttaaagcagtaatgtgctatggtgacagtaatgacagacaatgttaattgacagaatggctactctgaaccaggcactgtcttgtactcctgttatctcagtggtcttcacacttattctgttaggcaggactgtcatcctccccacattacagatgaggaaactgactgaggcttagagaggagactttgcaaagatcatgtgattaaaaaatggtagaggtggcaaaacagcctgtgtttttaacactgtcccatgtcagctcttattccagatcatcacataaagtctaatctctaatcttgaaaaccgaaaagcacctgccacctcagataagagagaccaagaccctagacattcgacttgtgttgaattcactcttattttgttttgatgtttgtaatcccagagccatacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatctcccatttgcttttctgcactatcagcagagtctggcttccttttccaccccctctccaatgtgaatgctttttaaggtcgtggaattagaatttaaaaaaaaaatttttttgagacagagttttgctcttctcgcccaggctggagtgcaatggtgcaatctcagctcaccgcagtctccgcctcccaggttcaaatgattctcctgcctcagcctcctgagtagctgggattacaagcatgcgccaccacgcccagctaattttgtatttttagtagggacagagtttctccatgttggtcaggctggtctcgaactcctgacctcaggtgatccacccacctcggcctcccaaagtgcagggattacaggcatgagccaccgcgcctggccagtattagaatcttttaatgggaacgtcttaaacataacctataacaatgaagcaccttataagtgtgtggagatttccttttcatggcttttcatatatgcctcgcactcacccagcaaccctgcaaactggatgttatactcaccagagagccttgaccctgattgtcactggcaaggagcagtgtctggacttgaacgcaggtcgcaggactccactcatggtgctctccccactgcacctcaattcctcacttttcaaaggaggcagcggaagcctggagagtttctcaaaggaaacggaatgcagaaatctgtctgtgtgcaatgtgaggctcagaactgaaaaccataaatgtcaggaaatgcaaagcagaattttcccctgcaacggcagtttgcatgaatatgaagacgctgtatggatgaaagtttgtggctgcagcatgagcataaatcctcggggctgctgttcgtctaggagcctgacttgcctggtgttgccctgagaactgcaacttgagcatttccttaattttgtactaaaggaaccaaaatgaggtattttggttctaagtctttgtcatgtgaaggaagcttcctgttaccaccccccatctacatacacattctctttcttagccccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatggggaaactccatctctactaaaaatacaaaaattagctgggtgtggtggcatgcgcctgtaatcctagctactcaggaggctgagacaggagaatcgttgaacccaggaggcagaggttgcagcgagctgagattgcaccactgcactccagcctgggccacagagtgagattccatctcaaaaaaaaatagatatatatatattttttatattatattatatattatatatttatatttttatatatataaatgaataaacaaggcatctgcttatgaaacagtctgcctgaatgaaatctccatttgcaggcaacacagtctacagtaatggcaggactgtattaggcatggttcctaatgcccatttctgtagcaaagtcaccagtagttcctaattgccaaaagtgagtcaccggtagttcctaattgccaaaagtgtattttttgcttttatcttgcttgaccacagctgtcatataaacctgttggccacacccttttcccttagcctgaatgaaaatgccccttcctgcccttcgtagctcctgagccaccaggacatggtggtctccatcatctgttcgttatctctaaccatttaagattagtgctccccaaggatgtctgttaacctgctttccttcccattctgccagtttcccctggggaatccacacttctggttttaaccatcacctaaatgctgtgtgtcccgacccgcatccgcatgctcccaggccattctcagttccagacccgggcccccagcttcctgcagacgcctcctccaggagatctcagtatcttgcttttcctcctaccccttctaaggcattctcaatccagcttccagaggaatcttcctaaaacacatctgactgtgtgagccacatactgtagcccaacctgacagcttcttttctatattaagaaaaagtgcggccgggcgcggtggctcacgcctgtaatcccagctctttgggaggctgaggcgggcagatcacgaggtcaggagatcgagaccatcctggataacatggtgaaaccctgtctctactgaaaatacaaaaaattagccgggcatggtggcaggtgcctgtagtcccagctactcgggaggctgaggcaggagaatggcatgaacccaggaggcggagcttgcagtgagccgggatcgcgccactgcactccagcctggacgacagagtgagactcgtctcaaaaaaaaaaaagaaaagaaaagaaaaagtgcacacattttgacatctgagaaaagtgatgtttttcttagaaaagtgacatctaactctttatagaaactttgccacaaggtagtctaggagtccccttactacctaagattttcatggacatgccctgtctgatcataaagcatgtggcacagtggctcacgcctgtaatcccaacactttggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaactactgcacccccacacgctccctgttaagtgtctgcatatctgtgtcttactgttgtttaaaattcacttgtctgcctggggagtggggtggtttgctttaagctgctccactcaagtctcagcagagaaagcaataatttgttatgagatagagttttaagccaagctttggccagggtctctcccatttgggaggaggaaaataggaacaagtgagatgataattttccttgaattttagctcattaaaatcttcccttgtcctgggcaggctatttactgatttaagcatctagcacttttcctttccagaaagaattaacatctatgatgcaatcattgctaagggaggaggtttttgtgttttctctgtggaattagctgttctccagttgcagatgagcacagcccactttagagttgtgtgtaggtatggagttgaggggtcggaatgagatttccaagatttataggtaatgaaaagaacaggttgtatcaaagacaccacgtgtaggaaactaactgttcttaggggacttgtgtgaacctgtgatccttggctttctccaaaatgaacatttcagccttgttcatattaacctcctttttacagttgttttaccgtgttctggttttgctgctattctgcctgaaaatctagcaaaatggcgtttcttatctgcagaactgcgacaaagcttaaacatttgtatttctcttgaggattactgtggttgaatttttgacagtactatatataaatgaagaaataaaattttttatacagatgtttaaaatcctctttccactagaacatttctttctccctaaatatactattacctggaactctagctgtttttcagatctgtagagatcataggtggcttaagggactagattgctggtgatattggctgcaaaattttttttttttttttttttttttttttttttgagacagagtcttgctccatcgcccaggctggagtgcagtggtgcaatcttggcttcactgcaacctctgcctcccaggttcaagtgattctcatttggctgcaaagttcttagtgaggtttagtggtattttggccctgtggcacagaagaatggttatttagcaaatgtgttttgcttttgattttgttttgtttttgagacagggtcttgccctgttgcccaggctggagtgaagtggctcgatcacagctcactgcagccatgacctcctgggctcaagcgatccttccacctcaacctcccaagtagctaggaccacaggcatgcctcaccacacctggctaatttttattttattttatttttgtagagacagggccttactatgttgcccaagctgttctcaaacttttgggctcaagcagtcttcccaccctggcctcccaaagtgctgggattacccagcatggcagcatgagccaacaggtctggcctcggcaaaggttttagtagggctttctcttttcttttgaagatgattaatacagtagattcatacagccagaagctgaaaagcagggaatactgtttggcttattaatggataatcaatcagtgttaatacacttttccctatttacatggtcaaattgatcaaatatttccaaggtattagcttttaaaagttgactttgtcagctctatgaaaagacatgcatttacatttttatcgtgctcctcctctgtcaggggacttggatctgtccttgatcttggcttttctgttcataaaccaggtaggactgtcatgggtttgctcccattaccatctcttgtcccaagatttctaaaaggcatcacctgatgcacccttttgcccaaatagtgttaaaagtcctcaggctgaggagctgtcctggttcttctacaggatctttaatgatcagcctgtctaagctgagaatggataagggtgtccccaacacgtttatttggtggtttggtgggggtagtgacactggggatgcttttgtgtgttgtaatctgcccctctgtctgtttgaccccagagactctgtggttagttgcaggacatcaaaatacgcaggaaagacagtgggggaagagaccatcagtcgccctcttgctgcctaggttcactagaatctctaagactgaattcactaggagacacaggacataccgtagagctgtttatgtcttgagagccccagtttcctagtctgttaaatgagcatagtaacaccaatctcactcctttggaatattcaatggtgtaatacttacaacatctagctgacctgtacaattatagctattctcttctgcaagtctaatattcctattcacccctccctctgcatagggatccagtttgaaatcatcagttgctcagtagggcctggggagctagctggtcattctttggttaaagtcaaagccaacctctttgcctacctttttgtcttaatgtcaacttcctaccagacatgttcctcccgcactggatgatcaaaatgcaaataggatggacacgatcaatgcattttgttggagtggttgcattctttctactttcttagggcaaaaaaatgaatggttggacaagagactaaccaaggcctcaaagaaagtgaaattctttctcaagctcctgaaagtcctttcatgggtatagtaacagttctataggggtctcattgtgatggtgccattatacaggccagcaagccccctgtgtgagccagacctcatggccttagcccttgttttcctctttttttttttttttttttttgagacagggtctcgctctgttgttggagtgcagtggtgtgatctcggctcactgcaacctctgcctcctgggttcaagtgattctcgtgctgtagcctcctgagtagctgagattacaggcccccaccagcacgcctggctaatttttgtatttttagtagagacagggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctgggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcaggtaaatgtcttcacattggtgttgagccactgattaggtcagatagttcaaagaaatgttaaccttttcctaagaggttatgtttctgaaatgttagcagtcgtcaacattaatatatagggtaggaaacttagactgtgggctacctgatagaaccatgctgttgagcaaagagagaccaagatggcggttgaggtgtctgctcccacagtgaagtgccccctactggcctctagcagtcaggtcagttgtgacctcaagtagatgatttgtatgtgtgtgaggtaaactagaaatagcggttttcacagtttcttaaaaattagtaaaaccctttcttccaaagaaatcttcgtggaatctcactatgtaaaagcagatgagcgccggattgttgggagggatgggaataggatcagcctgtgtgtctccctgatttcctcttgcattgacccatgaagcacatccttggagccccagagtcatctcagaacagtatgaaaatcaccactagatgcagaaactgttgtaggattggtcctgctatttgatggcattttgccaaggtatccaggaatactcaagaccacaccaggcccactttgggggcagcccaagcagtgcccgcaacagggcagccagcagccccgggtccagcaggagccggcccagagtgggttcctttttccagttcgtagaaggactgaggctaagaaagccttggagcacacccaggccctcagcaagtccctgagtagcacaggtgagccagagacgatggcacagggaggcagaggagagcccctcttcctgattccttctggctttggcctccaaatgtttgtgtggaagagaggactgtgctgagctgggctggaggacaggggcagcttttatccctaaagctgggcagaacatgcaccaaggttggcagcctctgctctccttctcctccaccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctctttttaacaaacagaaagcatgtactaaataacattttaaaaatatgtgtaatttattcatataactttttttcccctgaaaaaaaaaaaaaacaaagcctaacctattaatagtggacagggcttcctctgttcagcatcccagtcagattaggaaaatcagttccaacatttgtttcttgtaaatgaatgctgctttgctgtaatatttacttgctgtgttttattaaagttttcatgtaggacagttttggcagtcatggctggagataggagtctactttgatgttctggaatctctttgagctctgtggttatatgacagtgacatatattttgttagtgaaagtgctttatttttaataaggtttccttttaggacccttatttttgaaaaaaagtattccctgaaatattagatatcaatgtaatgattctctgggggaaaaaaagaccaaggcgttacagatgttcctcgactgaccatggggttatgcacagataaacccatcagaagttgaaaatatcattagtaaaaaatgggcatttgtagccaggatgggatgtgaaaacagaaaacaacgtccaaaaatgctggcagcacagtacgctgtagagtattggttgtttggcctcgtgattgcatggctgaccggaaaccacgatttgctgtcactgctgcccagcgcctcaagacagccttgttctttgtatagctggcctgggaaaagatcaaaatttaaagcacagtttctactgaatgcatgtccctttcccaccatcataaagtggaaaaatagtaagtgaaaaggttgtaaatcagggatggtctgtgtatttcaaaatgattctataagtagaatttatttgaaatttatctggcccaactgtaatagttttcttgttggtttttgaatgcccagtgtccagaatagtacctgacgcttagtaaccgctctgtgaaattttttttttttttttggagacagagtcttgctctgtcaccctggctttagtgcagtgggtgtgatcttggctcactgcaacctccaccttctgggttcaggtgattctcctacctcagcctcccaagtagctaggattacaggtccctgtcaccacgcctggccaatttttttttttttttgtatttttagtagaagtgtggatgcaccatgtttgccaggttggtttcgaactcctgacctcaagtgatccacccacctcggcctcccagagtgctaggattacgggcatgagccactgggcctggctaactctgtgaatattgagtgtttgacaagttaataagcatgaatcaaaattctactctgcttgtagttttaagttagtggcatgtttagaaacatttccttgaatttgtctcccacttaaagatggggctgatggccaggcacagtggctcacgcctgtaatcctaacactttgggaggccgaggcaggtggatcacctgaggtcgggagtttgagacctagcctggccaacatggtgaaactcttgtctctattaaaaatacaaaaaaattagctgggcttggtggcaggtgcctgtaataccagctactcgggaagctgaggcaggagaatggcttgaacccaggaggtggaggttgcagtgagccgagattgcaccattgcactccagcctggatgacaagagcttttttttttttctcaaaaaaaaagaaaagaaaaaaaaatgggctcaactaggcagtcattgagataaagatgaggaatgctatgttgatgaaacagatgaacagtttcggggtggtgctacccataatagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaaatcaaacccaagaaaggaagaagtccaatgaaattctgaacatgtaagaaaagtcagctttagagaaattggacatccgtgtaattttcattatgccaaagcaattgatataaaattaggatctttgcttgtgactcttgaactttagtaattccaaaatccattgtacctatcactgttttcttttatttattttttcctgtaaattctggatattctagatctatccctgaagtatattgccagttttccatttcaaattttaattagttctcaatacaatgtatttaatattttgctttttttaaaaaaagtaaaggttcatgtcatttagaatatgcagcactgtataaatttccttgttaatttggtttcagtggtccaaattaagttattactaatagcttattagtatcagtttactaatattttaatttttttaatcatgtcttacattgcattcttttaaaaactagtgatatgctgtcatttgacagtaagaattcaaataatttaaactaggattgcaactctcaagaacactgtcacaaaaattttaccaaatgatatgtattagtccattctcacactgctataaagaaatacctgagactgggtaatttataaagaaaagaagtttaattgtctcacacttccacggactgtacaggtagtatgatgctggcatttgcttggaaggccttctggaaggcctcaggaaacttacaattatagtagaaggggaaggggaatcacatatatcttacatggccagagcaggagcaagagagagggagggcgtattagtccattttcgcactgctgataaagacatacacgagacggggaagaaaaagaggtttaattggacttacagttccacatggctggggaggcctcaaaatcatggcgggaggtgaaaagcacttcttacatggcagcagcaagagaaaatcaggaagatgcaaaagcggaaacccctgataaaaccatctgatctcatgagacgtatttactaccatgagaagagtatggggaaaaccacccccatgattcaaattatctcccactgggtccctcctacaacacgtgggaattatgggagtacaattcaagatgagatttgggtggggacacagccaaaccatatcagaggaggaggtgcatactacatacttttaaaaaccagatctcaggataactcactcactatcatgagaacagcaccaatgggatggcgctaagcctttcatgaagggccacccccatgatcctgtcacctcccaccaggccccacccccaacactggggattacaattgaacatgagatttggtggagacacagaaccaaaccatatcatgatactcattttatttattgcattttactttatatcctacaaagtcaatatatttaactgaaaaactggctaccagtgtttttgtttttttttttcaagttctacctgtactgatttctaatttttagccattcctgattttaaaacctcgcatacattttggggataatttgttctcctagatggcgagaaaatatttaagtctgtgggcttggagaatgcttttttgataagaaggatgcccttggccagactgcatagaagctgagatgtttccgcagagccgagatggcatgaaggctgaagaattttcctgcatccctcccactgcagtgattgttctggcaaagttcccagggtggtctctgcactgctcatattagtgaaagggtggttctgatttctgaggaaggcatgataacactttggccttaaattttctttttgcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtctgattctgagttgccagtcttaattgcttgagattctctggattcagaacttatttttattttttttatttttattttttgagacagagtctcgctctgtcatccaggcaggaatgcagtggcgcaactgcaggcccactgcatcctgagctcaagcgatcctcctgccccagcccccaggtagctgggactacagacatatgccaccatgcccaactaatttttttttttgaggcagagtctcgctccctcccccaggctggagtgcagtggcatgagctcggctcactgcaagctccgcctcccgggttcacgccattctcctgcttcagcctcccgagtatctgggactaaaggcgcccgccaccacgcccggctagtttttttttttgtatttttagtagagacggggtttcaccgtgttagccaggatggtctcgatctcctgacctggtcatccgcccgactcggcctcccaaagtgctgggattacaggcgtgagccaccgcgcccagtcccaactgatttttgtaccttttctagagacgaggtttcaccaggttgctcaggctgctctcgaactcctggacttaagcaatcctcctgccttggcctctgaaagtgctgggattacaggtgtgagctactgcgcccagcctgaatgcagtcttaaaactgaattagaaaatctgagtgcaggctagagttatatataattaagagagtgtgggttttaagttgtgtcttaaaattgtgttgtttttggtcgagtctggtggctcacacttgtaatcccagcactttggggggcctaagtgggctgattgcttgagctcacgagttcgagaccagcctgggcaacatagtgaaactctgcctctacaaaaaatacaaaaattaagcccaggtgctgtggctcatgcctgtaatcctagcactttgggaggccaaggctggtggatcatctgaggtcaggagtttgagaccagcctggccgtggtgaaaccctgcctctactaaaaaaatacaaaaactaaccaggcgtggtggcacatgcctgtagtcccagctacatgggaggcagaggcagaagagtcccttgaacccaggaggcggaggctgcagtgagccaagatcgcaccactgcactccagcctgggcgacagagcaacagtccgtctcaaaaacaaaaaacaaaaattagccaggcattgtggcatgcgcctgtagtcccagctacttgggaggctgaggtgggaagatggcttgagcctgggaggcgggggttacagggagctgagatggtgccactgtactccagcctgggtgatcgggccagaccttatctcaaaaaaaagtgtttttaattacttgtaattttaattgcttgtaattaaaaaacagtaattaaaaggaccaaaagttaattttgcaggtagtaaaccttagcctactgtacgtaaaaatcagaaggccaaggcaggaggattgcctgagtccaggagctcaagaccagcttgggcaacatagtgagaccccgtctctataaaacaacttaacaatgtgccaggtgtggtggcacacccttgcaatcccaactactcaggaggctgaggtggacggattgcttgagcctgggaggtcaaggctgcaatgatcgtgatcacatcactgcactccagcctgggcaacagagcaagaccctctgtaaataataacagtaataatcagaaagcaacactgtatgtgaataaagtcaccttacctagctgccggtggacagcctttggtgtttcaaggacttagtttttatgcgttcctgctttcgatatttgttgactgtgagctttgggcttatccagggtccatgaagaagaaatggctcttccttatctcaggcttttgttattttggggtgttttaaattcctctcctgtggttactcaatccgaccctacttgcctctctcttccacaaatttctcaaatgtcattcatggtacccttttaactcttacggacttacttgtttttaacatatcttttattcactttgaatggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagccaaaagattacacattgctgaaaactttagatgtatcaggaatcatatagcttttcaaaataaaatatccacacttttgctaagttctatgctatgcaagtgactgaactataccaggacttatcttgtaaacttggaagtgaaatattcttcactcgcaagggtattttgtgattaaattctggaaatatgcatttataagttgataccagctcctggaatgtaactttttcttttttctttttttcttttttagattttttgagatgaagtctcactctgttgcccagggtggagtgcagtggcacaatcttggctcactgcagcctctgggtcccgaggtcaagcaattcgctggcctcagcctctgagtaggtgggactacaggcatctgccaccacagctggctaacttttttttgtatttttagtagagacagggtttcaccttgttggccaggctggtcttgaactcctgacctcaagtgatccacccacctcggcctcccaaagtgctgggattacaggcgtgagccaccgcacccggatgctttttctcatttctccatcgcttaaagatagaggattgagagaggcccgtttgtggacacgatcttaagtacagatctctagtggttaaaacgaaacacaacaattctctctcatcctctagactcttggcttttgcctaaatatgattcataaagctgaagtgttgctaatctttaaataacacccaagggatatgattatatgattacccaacaccctaatacagtttaagaatagagtgatccaaagaaggagaaaatagtgtcttcaaaaatgttgctattagaaatatttcttttctctaagggaggatgcaggctaaagtatttagcatgtgtgtttacttttataaattttctaagtgatgaaggaaggaaggtagaatctttttttttttttttttttttttttttcagatagagtttcactcttgttgcccaggctggagtgagtggtgtgatctcggctcaccgcaatctccgcctcccaggttcaagcgattctctgcttcagcctccctagtagctgggatcacaggtgtgcaccaccacgcccagctaattttttttttttttttttttttttttttttttggtatttttagtagagatggggttgcaccatgttggccaggctggtctcaaactcctgacctcaggtgatccaccctactcggcctcctagagtcctgggattacaggcgtgagccactatgccctgccagaagtagaattcttatcaacatctttctaggttgataatcaggtaatccctaaagttaataccctaaaatgcaattttttagttttgatggaaaattgattctatcccttttttttttttttttttttttttttttttttttttttttttgaggtggagttttgctcttgttgcccaggctggagagcaatggcacgatctcagctcactgcaacctcggcctcccggttcaagcgattctcctgcctcagcctcctgagtagctgggattacaggcatgtgccaccacgcctggctaattttgtatttttagtagagatggggtttctccatgttggtcaggctgttctcaaacccccgacctcagatgatccacccggcttggcctcccaaattgctgggattacaggcgtgagccaccatgcctggccggttctataacttctatgatagagaatttttaaattatcaaaaaagcctgatctttcatgtaacactttgaccagtcttaccctgtgagtgttttcatctgccttctcacgctttgcatccacaagtgaaagtgcttctatttttctatgtattgtacagtaaagattttagagctttctaggccaggcatggtggctcgcacctataaccccagcactttgggaggccgaggtgggcagatcactgaggccaggagtttgagaccagcctggccaacatggtgaaaccctgtgtctactaaaaatacaaaaattagccgggagtgttggcaggtgccgtaatcccagctgctaataaggtggaggttgcggtgagctgagatcgtgccattgcactccagcctgggtgacagagagagactctatctcaaaaataaaaaaaaaaaatttttttagatccttctaataagatgaagcccactgtgtcaaaaaaaaatctaaaggttaggatatgaagtcattctgacagattatgctgtggaagaatatatatccctgttcctttcttctgagccttactttcatgttaatagtttaaactacatactatatgccaagaactttatataccttatcatatttcattttcacaaaattttaggaggttgatattactcacattaattaacaggcccaacatcacaatttctagcaagaggaagaggtatgcttttaatgcaagtctgactctgaattctgtggcctaatctgcagtctatgttgcatccacatgttttaaatgttcgctatgaattctcttgagctattatttctatctctaattatgccataatttaaaaatcagaatacttgggctcgtgtgaagagatggtgtgcctagatgtttcttcctggctcagtgtgagatatgattttgaaagcacatgatgtgcttcattacattttttaaatccatttatcccaggttaatagcttagatggcctttttttttttttttttttgagatggaatcttgctatgtcgcccaggttgcagtgcagtggcgtgatcttggctcactgcaacctccaccttccagcttcaagcgattctcctgcctcagcctcccaagtagctgggactacgggtacacgccaccatgtccagctgatttttatatttttagtagagatggggttttgccatgttggccaggctggtcttgaactgacctcaggtgatccacctgcctcggcctcccaaagtgctgggattacaggtgtgagccactgcacccggccagatggccatttctctaatgtaaaatgtgaagcaggcccaatggagggccccaagcctgtgccagaggtgaccagtctgcagccgtgccccgacatcctaacttccttggtgaaaaatgagaccactattcagtgtgctagctgtttacaaggagcaattggttagaaatgacagtgtactgaaagtcttttttttccctccaattttttacagggaaggttgggtgtggctctccaagaatacattttggtggactcattgaggaagatgatgtgattctccttgctgcagctctgcgaattcaggtttgttcaacatagctgtctgagaatcttgagtttggaagtttgattaatagttgctaacattttgcaagtggtttctgtttaccaggtacagtgttaaacacttcacacacagtgttaggcccatttgataagtgaagaaatggtgattttgaaaaatgaagtgagttgcctatgatcacatggcagtgtggggcagggacccatcctggggactgtgtatgttatcttgtgctgtgtaataaattatcccaaaatttagcaactgaagcaacaaggcatttattatctcacagtttcttcaagtcagagatttggtagtagattagcagattaggtggtatgttagtccattcttgcattgctataaagaaataccagctactcaggaggctaaagcaggaggatcgcttgaacccaggagacagaggttgtggtgagctgagattgcaccactgaactccaacctgggtgacagagggagactgaaaaaaaaaaaaaagaaatacctgagactggttaacttagaaagaaaacagatttaattggctcacggttcttttttttccccttgggacagagtctcactttgtcacccaggctggagtgcagtggtgcgatcttggctcactgcaacctccacctcctgggtttaagagattctcatgcctcagcctcctgagtagccgggactgcaggcacacaccaccacgcctggctaattttttgtatttttagtagagacagggtttcaccatgtcggccaggctggtctcaaactcctggcctcatgtgatccacccgccttggcctcccaaagtgctgggattacaggcatgagccaccgcgcctgacctggctcacagttctgcaggccttacaggaagcataacacaggcatctgcttctggagaggcctcaccaagcttccaagaatggcagaaagtgaagggaaagcaggcatctcacaaggcgggaacaggagcagagagtgagggatggtgctatatacttttaaatgaccagatctcatgagaactcattcactatcacaaggacgctaccgagggagatgatgctaaaccatcatgagaaactagcccctgtgatcccatcaccctccaccaggccccacctctaacactggggattacatttcaagatgggatttgggcagggacacacatccaaactatatcaaattgtttaggctcaggatctctcatgcatttgaagtgaagatgtcagctggggctgcagtcatctgaggcattaactggggctggaggatctgtttccaagatggcatactcacatggctgtgggcatgtgtatttcattcctcactggccatcagcaggatgccttggttcctcatcatgtccacctctctgtagggctgctcacagtgtggcagctaacttcccccagtgtgagcaatccaagggaggcaaccaggaggagtctgcagtgtggatgacctgggctctaacctcatgtgccgccacttccttttatcctgtttgttagaagtagatcactaagtccagttcacattcaagagaaggagaattgtcctcacttcttcaagacaggagtattaaagtatttggaggcattttttcaaaccaccaccacctgtgtgacctaaaggcgaaggtcatcagtgttccaccatataagctgagtgttctcatggtgctggagcctgcagcagtggtggcctctggcagtgacatttagttcatttctttcttatgtacagggtaatacacaattgaaactctttacctcaaaatgggtcattagacatttttgtaaggattataagttacatttccatcaaagccaaattttatttttatttatttttatttcatttacttataatttatatgcatacataacactactcagtagttcaatttgcttgctcttttataccaactatggaaggatggtatttggaagctgggcatccaagctgatcattcacgcagtcctatattttcttcatttttcttttctaaattggatgacgaacctattcagtataagtttatccatgtacatgatgtcttttgtgaacacttaatctatttatttatttatttatttatttgagacggggtctcactgtgtcacccaggctggaatgcagtggcacgatctcagctcactgcagcctccacctcccaggttcaagtgattctcctgcctcagcctcctgggtagctgggattacaggcacatgccaccacacccagataatttttttttttttttttttttttttttttgagacagagtttagctcttgttgcccaggctagagtgtaatgtcgcaaactcggctcactgcaacctccatctcccgggctcaagtgattctcccgcctcagcctcctgagtagttgggattacaggcacatgccaccaccacgcccggctaattttttgtattttttgagatggagttttgctcttgttgcccaggctggggtgcaatggcacgatctcagctcactgcaacctccacctcccgggttcaagtgattctcctgcctcagcctcccgagtagctgggattacaggcgtgtgccaccacacccagctaattttgtatttttagtagagacggggtttctccatgttggtcaggctggtctcgaactcccgacctcagttgatcccgcctacctcagcctcccaaagaggattacaggcgtgagccactgcacctggcctaatttttgtatttttagtagagacagggtttcaccatgttgcccaggctggtcttgaattcctgacctcaagtgatctgcccacctcggcctcccaaagtgctgggattacaggcatgagccacctcacctggcctatttattcatttatttttaaagagacagaatctcagctaggatgaagtacagtggtgtgatcttgactcactgcagcctcaaacttctgggctcaaacaatcctcccacctcagcctcccgagtagctgggattataggtgcgcatcaccacacctggattttttaatagtgtattttctcacattttcctgtttttctttttaaaatttaacaaaaacaatgaacatagtcagaagttctggcctgtgacttgaaataaccctggatgtacatttttaaaaacattctcagattcattgctgtaagtatgaagagctaatagtctgcaagggaactatagaattaagctggatcatcaagttcatgcatgcatatttaagaaacagagcagcttcttttaatactatcaaactcttcagtgcgatattgaatagttgtatatctaactagtggttttcacgttttcctttttaagaaaaacctacaaacctagttacacgtgaataaaaatattcctaatatcctcctggcttattgtgcgactcgataatcttgttttgtaacatccacaaacaatatttccatggtttaagtgtgtgccctgtcagcttttaccattctaacatgttttcccctctatccctgctgaagaacatggtcagtagtggaaggagatggcttcgtgaacagcagcacaggcggtggagacttcactgcttgaaacttcagcctctctcccctgtgccaaggtaacactggtgttttatttacactgatgtcagctcagcacagtgccttagccctagttagtcatgggggagaagcacaactcatggtactgtggttttgatggtagataagtttctctattcattaaattgccaccctattttctctattgtaaattctccaaaattaaatcataatgaatgtattactgtgttctgtcaattctaagaaggcatatttttttatttcaatgatgttttctatattaaatggcagttttttaatgatgttttaaaattaatttatattaatttaatttcaatgatgtttcctatatttaatggcagtgttttccccccccacccttttttttttttttgagatggagtcttgctctgttgcccaggctagagtgcaatggtgcgatctcggctcactgcaacctctacctcccaggttcaagcgattctcctgcctcagcctcccgggtagctgagattacaggtgcacgccaccacacccagctaatttttgtatttttagtagagatgggggtttcaccattttggccagccggtctcaaactcctgacctcaggtgatctgcccaccttggcctcccaaagtgctgggattacaggcgtgagcgaccacgcctggcctggcagtggtttttcttcttagtggtccatgaagtaatggttttaaatttgacaaaatatggtaatgtaatatttggaatatgcttttcaatgtcagaaatgcccaacacgtatatatccgcctggtgttaagggccatataggtttctactctggggataaaggaccgtccaaaccaaacattattccacgtgggaactgagctcagctttcttcagaacgatctgatagaatagtctgtgctcgtcaaggtggatattttcctcagagtgctctctgatgaggtctgagctacatattctatctataaatttggaaatataaactgtaggtcatagtctcagcttgtggtttagaatgattgggtagggatgatgtctgaatcagacagctgcattttccagcctgatgatgagtcatctgtgtctgtcccactccaaggaattggccccacccccattatccaggtgtgcataatactaggtgtgcatccccaggtaatctcatccagcaacgttggaatgcacacagtgccgaggagataaaatccctctagtaactgacactttatttatttatttatttatttatttattttttcttttttttttttttttttttgagacagagtcttgctctggtcttgaactcttgacctcaggtgttccacctgcctcggcctaccaaagtgctgggattacaagcatgagccaccgcaccggggctgactcattttttacctgataaccagttgctttatagaattgaactccatttccttggacagtcagatgaacaccctggttcagttctacccactaggagggtgtgaccctcctggacatgttttcatccctgcaatagacgaaacatctcagttatgctctctgttcattaattatataagttgcaatgaggaatgttattctttgtaatatcatccctgggcttgtgcaatctgtttcataaaatatcttattttagagttatttttgttgttataagaccttagattttaaaagtaaatcaataatttctacttacaaagtgctaaaaaagattaagatagattccaccaaattgtgtaccaaagtttcaaagtaaattcttcttgttaaataattaaatccttttctcccccaagaagaatttactttgaaatcattgatttctagacccactgggcaaagagaagcaggctgagtagtttataaatcaccccaaaaatcggatgatgtctctgtgactagctagtaaagagaaaaccttacaggtgtttgttttgttttgtttttgagacagagccttgctctgttgcccaggctggagtgcagtggcttcatctctgctcattgtaaccttcacttcctgagttcaagcgaggacatctggctaatttttgtatttttagtagagacagggtttcaccatgtttgccaggctggtcttgaactcctgacctcaagtgatctgccctcctgtgctcccaaagtgctgggcttacaggcatgagccaccatgccaggcctgttttgtttgcttgtttgttttttgagacagtcttattctgttgcccaggctggagtgcagtggtgcaatctcagctcacctcaacctccgcctcccaggttcaagtgattgtcctgcctcggcctcccgagtagctgggactacaggtgccaccaccacacctggctaatttgtttgtatttttagtagagacgggattttgctatgttggccaggctggtctcaaactcatggactcaagtgatcctcccgccttggcctcccaaagtgctgggattacaggcgtgagcctctgcagcctgccaaaagcttacacattgttcaagattaagctcttcaatttaggagattgtgggaagagagagacagaaaaaaactatggccaggaaggcaaaacaaagtaggaggctagaaaggaaaggtcggataggtggaggcctggaaaggaatactcagcggtacttgaggggggtaacctgaactcctagtttctctggtgccctttggagaagtctgggtggaggtgtgtttgctgttgcctcttacccccgggtcaggcccctacaggatcctggaggagagtctagggtggtctgaacactgagggtagattacctgcagtagctacagaaacagtcagggccaaggggctgactaaagtccactgagggggttgatctgcccaccgcaaggaggcagaccacaacaaaaataagtgttctggggtgagtgaaggaatagctgtcctctctgatgcaacctttaagggtagtcccccgccgcgtggtctcccggggttagtcttgctgctgggggaacaggtgtgccttccatctctcactctcagacacatgaagggcctgactgcccagcaaagaaatgactgagcacatgagccccagaggaaagagtccagcattacacatgctggtatccagaccactcctgtaagacgagcagtggtggccagtaaaatagaagagttcagttacgtgcccaatgactctctggagttcctacaatttcctgtctgaacttgggctcagggcactaggtccttttaccgacagttatgtaattaataaaacattttgaaatatgattttagactgtaaatagagagggggaagtgtggacacagataaaacgaaatagcatttccacattttttctttttttttgtacttaatctctaatgtgatagtaatgttcacatttttgaatagccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgtgatctcagctcactgcaaactctgcctcccgggttcaagcgattctcctgcctcagcctcccgagtagctgggattacaggcatgcgccaccatgcccagctaatttttgtatttttagtcgagatggggtttcaccatgttggccaggcttttctcgaactcctgacctcaagtgatccacccaccttggcatcccaaagtgctgggattacaggtgtgagccaccgcacctggccacatcccagattcttaaacatgttggggaagcaggggctgggggagtagcaaaatgcccaggatgagggtggagatcccatcttacacatcttctggcacctctagttccatcaataagtgctaccctggtagttctgagtgtttctaattgtccaagtgcactgatgcagaaaaataatttgaacatagaatagggatgttccacaacttacttgaccaattttctattgatgggcaatcaaagtgttcccaatttttgccattttaaactgctagaattaacaaccttgggcatgtggatttgtgcatctgtttaattatctccttaggaaaaatccccggaagtgagttcaattatttataaccacaaataaagcaaaaatattatccaaaacaggccaagcgcggtggctcacacctgtaatcccagctctttgggaggccgaggcaggtggatcacaaggtcaggagatcgagaccatcctggctaacatggtgaaaccccgtctctactaaaaataccaaaaaattagccaggcgtggtggcaggcacctgtagtcccagctactcaggaggctgaggcaggagaatggcgtgaacctgggaggcggagcttgcggtgagccaagatcacgccactgcactccagcctaggtgacagagcaagactgtctcaaaaaaaaaaaaaaaaaaaaaaaatcacctctttaatgatatagtgatttcttcaaatcctttttccctcctcctgtcccactttcctgtcctcctctttctccttctctttgtgtagcttttcttttttttttttgagatgaagtcacccaggctggagtgcactggtgcgattttggctcgctgcaacctctgccccctgggttcaagcaattcttgtgcctcagcttcccaagtagctgggattccaggcatgcacccccacgcctggctaactgtttttgtatttttatagagacggggtttcgccacattagccaggctggccttgaactcctggcctcaagtggtccgcccgcctcctccttccaaagtgctaggattacaggtgtgagccatcatgcccagcttctgtagcttttttgtaagagggacagacagccagggcctctctgaatccctcagcagttggcattgtaaggaattcatcctttgctccacaccttggttgcctgtggcttcacccttctcccgcaggcttccaggctcactgcagttagattcctgagcccctttccaacctagaaccccaaacttaatgtccccataatcgagtgtgggaaagttcctggctgaggggaggggttggctccacctgcaggcaccctctgggcccacaccctgcaaggagctgcctctggttagattggctccggggtctctgagtttagggcacagtttagtcagggttgttttatggcagtatgcttgatgcatatttgtctgcaattaataaacaaactcttggccattaagaccttgaaaaagcatttgatttgtgaaattggttcctttcttccaggcttcagatgatcttggtaggtgggtttgcaggctttctcaccctgttcagataggaacacttaaggaaaacttggtaggatgtgttgtctgtttatgaaggaagaatcctgcagcagattttcttatccagtccttgtgctttactccattttgggcttgtcaataaaatcagaaatccagatatggatggctctgaccttagcttggaacacaaaactgatacttctaaaacaaagctgtgatgatactgttttcaggttccttacttgtaaacaaagctgggcctccagcctcatgctggagaatgctagctagcacgactgcctggggttacagccaatgcagtccatggccagtagaacatttctccacgctggctttttgctagcattaatatgtataatcaagctgaaattggcctgccatgttgtaaatagaaaagaagactaaagatgaattttcaagaacagattaaacaccaagggatcaacaattctttttctgaaattctaagtttctttacctaacaaagacctttgaaggaacaaaaattaaatggcctgtctcttttttaactgtagtggaaaaaaataaccgtgctggtaagattatgatatatgtatgcatttgtggcacagcttgaagatttttaggaaatagccacactggattctataagggaagaatgaacagccccttctccccaacacaacaaatgatatattttttagggctgtaaactgtcatcagtatctaatcccttaatagctgaatattgatatcagtttagatcacaggcaactattttatcgatagcctaaagtgggcctggcatgacgggttgtgcctataacccaattactctggagactgtgggtggatcacttgaggccaggagttcaagaccagcctgagctgcatagcaagaccccatctttaaaaaatacaaacaaacagcaaaaagcagcactggtttaaagcaacatttgtaatctaaagtgaaaagtcaatttgaaataaaaatcatcttcatatttttacatttgaccaggtcaagcgttagggggaaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatgggtgcctgtaatcccagctactcaagagggtgaggcaagagaattgcttgagcccgggaggtggaggttgcaatgagcagagatcacaccattgcagtccagcctgggcaacagagtgagactccatctcaaaaaaaaaaaaaaaaaaaaaaaagcatcattccattgtcaacccttttttgctgttctgtgccctgaacaggtgatgtgatagcggtgcaaagagggtgagcattgtcctttacctcaacaagtgtgtggcctggtaggcgagacaggcatgtcagaatgcttatcatgaagccatctgaaaaattctagaataatcatataatcaatgctctagatatcagagagggggtacagaaatctgccgggagaagtggaggaatgtaatgaacaaaaatcacagttccatctctatgaactctaagctcccatagaaaaagaaattagagggctgggcgtggtggctcacgcctgtaatcccagcactttgggaggctgaggtgggcggatcacaaggtcaggagtttgagaccagcctggccaacaaggtgaaaccccgtctctactaaaaatacaaaaattagccaggtgtgatgacgtgcctgtagtcccagctactcaggaggccgaggcaggagaattgcttgaacctgggaggcagagattgcagtgagctgagattgtgccactgcactccagcctgggcaacaagagcgaaactccatgtgtctccaaaaaaaaaagagaaaggaagaaagggaggaagagagggagggaggaaggaaggaaggaaggaaggaagggagagagagtaattagattaccttaaggaaagaaggaaggaaggaaggaaggaaaagagagaaagaaagagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgctagcatatccttgggaatgaaaatgtaatccttcatgtgacacagtttaggtaaaccacttagtcctttgcaaacaccaaatgctcagtgcggtacttaaatgacaccatatttgatgccacagtttctttacaggctcttctaagattgtaatgcctgtgggcttttaactgcccttattgatgttgtatccaagaaaacagaaagttgactccaagcagaagtattaatatctttgtataactttcagtcttcacgttgaccccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctgcttcctgcctcagtggcgtttgactttcctgttctggaaacagtctcatccttggcctccttctgagacttcctgtcatgttctgccttcttctccagggtcctcttattttttgtgtttttagagacagggtctcactatattgcccaggctggtctcaaactccctagctcaagcagtccttttaccttggcctcccaaagtgctaggattacaagcatgaaccactgcacacagccgggttctcttattttatactacgccttcttagtttccttttggactctcttcttctgacaactcattacaagcaaatgtgcttaactcttctgtccttatcccttttctcactcggtgcactgtccttgggtgatcttacccattccatgctttaaatggctatagttatgatttccatccatggagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggtaagcttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcaaggagtccctgtacttatagttgctaacaaacaagacttgaggaactcattgtctctttcagaaattgagaaattgttagcaatgggtgaactgagctcatcagctccttggcatttgtagcctacctgtgcaatcataggagatggcctaaaggaaggacttgagaaactacatgatatgatcattaaaagaaaaattttgcggcaacagaaaaagaaaagatgaatatcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatacgcagcatgacaaatctcacatactattatctgaaataaattgaagtttataatttactcatttgaggtggttatgcggtggtttttttgtttttgtttttgtttttgttttgagacagagtctcacttggttgcccaggctggaatgcagtggtgcaatctcggctcactccaatctccgcctcccagtttcaagtgattctcctgcctcagcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcccttgcagactcttttcctgttctctcttggttccaggattttcccatgcctggaacattcttccttttctgtcctctttacccagtttagtcaaggttttttgtcaaggttcttctctaccccacagactccctctgtgtttacggctatctggttcagttggctgtggcgagttgcgggcctttcttgaggtctcaggtcccagcattgagcagagtgcccagcacatagtaggaactcactagaaagtacttgttgactttgttaaaggaatagaagtgtttacccatggaggtctgagtgtcagggaagctaaagagaaaatctgtaggaacttcaagtactgggagtgggggtgagaaagagtagtccaaggcactgctgaaaaaaatcgtcccaggcctcaggtcagaatggggatgggtaccattcatgagccagcaagacccagaaccaggaggccaaattagaggtggtgtacaaggggcatacacaggggaatggctcgggtttagccagcaaattggaaggacattggtgtcccgctggtttagggcatcagctgcgtggcttggaggagagagctacttttattttattttattttattttttgagatggagtctcgctctgtcacccaggctggagtgcaatggtgcaatctcggctcgctgcaacctctgcctcccaggttcaagtgattctcctgcctcagcctcccgagaagctgggattacaggcacctgccaccatgcccagctaatttttatattttaatacagatggggtttcaccatgttggtcaggccggtcttgaactcctgacctcaggtgacccacccacctcggtcttcaaaagtgctaggattacaggcgtgagccaccgcgcccagccaagaagactaccttatgagggtagagtgggccagacacactcaggcaatttgttccttgaagttgagtgcctccagtcttttcttcatctgtatcctcccagctctgagcaccgtgcctgacacttggtggatgtttgttgactgtgtgccaggcacagacaatatgtactggacggaacataataaatcaccataggggaaaatgttagaataaattccagatgggctgaggaattgaaagtgaaaacactatgactggaaggatgggaaggagccggccttgtgaagaatgagggagagcattcagccagtgggaactgctggtgggaaagtcctgaggcaggaaagggtgtggcctgttcagggaactggaggacaccagggtggctggagccccgtgggccagcgggagttgggggggttgaggtagagaagtgtgcaggcgccagctctgtcgagcgattgcaatttgtagccaagaacctggattttatttgaagtgccaaggtcagccattgaagggatcttgacagataacacaatgcagattgagttttattaaaatcaccctgtcttctgtgtgatgaaaggaccaggggcctctcagtagacacgatgaatccaggaggaagactatggaagtagcctagggaaagatgtcagtgacttggcccaggatgggggcagtgaggatggaaaagaggaaaaaacagtttaagatttgtttgctgatgtttgcaggattagatgttgggggttagaaaagaggaggattcaaggacgacatccagggtactggcttgagcaactcagtagactcatttgttgaggcagagaacaggggagtgatggtatgaggtttgaactgtgtggtgtggggtgtggtggagggtggtagtcagaaggagggagtcagtttagaggcctatgaaacatgcaggtggacatcaagtagacggctggaaagaaaaacttacattccagttgtgaaatggccaaagagttcaatagaaacatcgaaaaagaaatattaactaaatgcatattcatcttcaccaataatcaagtaaataaatctacattaaaaccactatcaggccgggcacggtggctcatgcctgtaatcccagcactttgggaggctgaggcgagtggatcacctgaggtcaggagtttgagaccagcctggccaacatggggaaaccctgtctctactaaaaatacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggtgtggtggcaggcgcctatagtcccagctacttgggaggcaggagaatcccttgaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgcggggctgaagcgagaggatcacttgagtccaggaatctgagaccaacctgtgcaacatagtgagactgtgtctctacagaaaaaaaaagaaaaaaaagaaaagaaagagagctcatttaacctagtaactacctcctgaaaatatattactcattagcaattaatttttttaataaaaggaaaagctatttgtgtatattctttataactgtggcctttcttgtaaaagtgaacatttggtagtagcgtatatatccagcctgaaacttttggtacatctaccgtatacagcttctataaactatacaaaagattattatagaaaaagttttgtgaaaaacgaaacttggaagtttgtaggaagatgattctacaaatgataatcgagtgtgctcatgagactggaaggaaaataacagaatgagtagagtcatgagggtaaaatactctatttctccaaagttctgtaatatttcatattattttattgttactgtttattttatgccctgcctcactccaaagtatatttgatatgatactgttttctagataataaaacaatgaataaacgtagtgagtgactataaggagattcattattaaatgcatcagaatgttttgccttaacctgaggatggaagaatttatgatctgagtaattgctcaaaggttctttgttgtcacgtggaaggctttgaccttgattttctgatttaggcattcctatagactcagctcattataaggatatgtaatttgcatgctattttatttattcagtccttaaattccatagttgtttaaaacaaataggaagatgtcttagccgagcacagtggcccaagagctcataaccagcctaggcaacatagcaagacccccatctccacagaaaattcaaaaattagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtcttttatctaaatagttcggttataaatgcaatgaatttttgtcatatcctgtgaattgtccaagttcatggacaactaacttttgtgtggtctcatttttgttttgtgtttttaggctctgtataatcggctggttcctttagtgaatggtgtcagagaattttcagaaattcagcttgctcggctaaaagtaagtttccagttagcaattctttaaaaagaaaatatcgtagaaacgcatcagaaagattgtcaaagcctgaaattttcaacttggtttgattttggttttcagatatccttttgggtattaaactctatagagaccgaacactggagcagagagagcacagtgttggaagcctgaaccctggttctacacgaaagagccaggtggacaaattaattaaccttttttggtctcagtttcttcgtctatgaaatgagaggactgttttgctaatttatgagtactctagtcaactgacaagttagctgggcacaggagcacatacatacctgtagtccgagctactcatgatgctgatgtgagaggtttgcttgagccaaggagttcaaggtttatagtgcaccatgatggcccctgtgaatagccactgcatgccagcctgagcaacacagcaagagcccatctcttaaaaaaaaataacaaattagaatttttggtgagtccttctctttctaaagtgaaatatttttatgaaatttgttaaatttctaggaaattataggataacctttgaaaactcatctatctcatttgtggttttctgttttgttttgttttgttttttgagacagagttttactcttgttgcccaggctggagtgcagtggcatgatcttggctcactgcaacctctgccttcctggttcaagtgattctcctgcctcagcctcccaagtagctgtgattacagacacgcaccaccgcacctggctaatttttgtattttcagtacagatgggatttcaccatgttggccaggctggtctcaaacgcctgacctcaagtgatccatccaccttggcctcccaaagtgctgggattacaggtgtgagctactgcgcccagcctcatctacgtttttgttgcagcaaacactacaattatacttgcgtatgccatcttaattcttaaaacctgtcttatcttttttctgatgccatttgctgcctctggtcttctaatcatattgcttgctactagccctgtttcagagactaaaaaataaccctaaatggtataacttaacaaccttactggttggtattaagtggttttaaaaattcacctcctgcctcttactgaaccaagttcagtgtgttgaattagtgagtaattccatcctcggcagctataacaacatgcagtttctgtttcccagatcttttttatgcttcattaaaaatcactattttgccaggcacagtggctcacgcctgtaatcccagcactttgggaggccgaggcaggcagatcctgaggtcaggagattgagaccatcctggctaacacggtgaaaccccatctctactaaaaatacaaaaaattagccgggcgtggtggcaggcgcctgtagtcccagcttctcgggaggctggggcaggagaatggcgtgaacccaggaggcggagcttgcagtgagccgagatcgtgccattgcactccagcctgggcaacagagcaagactccatctcaaaaaagaaaaaaaaaaaagaaaaatcactattttgtgtgtgtgtgacagtcttgctctgttgctcaggctggagtgcaatggcacgatctcggctcgctgcaacctccgcctcctaggttcaagcagttctgcctcggccttctgagtagctgggattacaggtgcccaccaccatgccagcgaattttttgtatttttagtagagaaggggcttcaccatgttggccaggctggtctcgaactcctgacctcaggtgatccacctgcttcagcctcccaaagtgctgggattacaggcatgagccaccacacccagccaaaaatcactttcttaagatgttttatttacacaaaataaataggaagatttcttggcttggtgtggtggctcacccctgtaatctcagcactttgggaggccaagacaagaggattgcttgagcccaggagttcatgaccagcccaggcaacatagcaagacccccgtctctacaaaaaatttaaaaattggctgggcattaaaagttttaatttttttttttctcctccataaattaggaataacttactttgaaacataggaataaacttaacttgaattactggtatttgtatttgaaaaactaaagaactgcggcatcaattatatggacagacagcagtttatgtctcttctgagcagcgtacatggtggccacatagagcagcccaaggagcccctggctaacgcagccagcagcaggcacaagtggtagttagctgtatgctgtccactgcaggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaacttatttgtgtatataagtgcctagaatgaaaagtagaaagatgtatgccaactgttggcattagttgcctgtgtaataaaagcgagtattgaaaaggccctttctctgcatagttttttactgtttaggtactggagagatggaagattcacagtggccttgatttcagtgcctactctgtgcattgtattgatagttccattacatatattagcacagttcatttgtaaagctgatttgcaaatgaggaaattgggatgttatgttaaaaaaacttgcccaaggttatatcttgtgttgcttcgtgcatagatatttttaagtaaaaaggggttatagtgtatttaagagctttaactgctttttatttatcataagactgtagtgaagacatctttttatgtcgataaaggtagacctgtatcttcatttttaatgaccacatcatatctcatagaggtaccatagtagattcagccatttccctgttaatgaacatgtagagtgtttgcagtttcaggctatcacaagtaagctgtagtaagtatacacatatatttgtgtgtatacttgatactatccttaggatattattccagatgtgtgattgcagagtccaagaggatacaaatttccaatgttgacatatgttttgacattaacttccaggaaattcataccaattcacatccttgccaatatcccatattggcctttgtttaaatgtgtgctaaatccctcatttgccctatcgtgattattacacattgcatacctgtatcagaatagttcatgcaatccacaaatatatacacctactatatacctaaaaaaatgaaaaggtaaatactaaatcaataaatgtgtgataagctgatgaacaataacgttttcattggcatctttatatgattttgaaatattttatttgcaaaacagaaatgagcagccttccgctatgcacgtcatttagtcattaaagtgaatgacagtgatactttaattgacccagtgtgtttcattttttttatgctcaagatgtgaaattttgtaattgtaacaattacaaatgaagagcttgaatatcgattatatattattcttatttacacagctaatatttcaagaatgtttctagtctcatgttttgtacagaaaatctccatattttttagtcattttctcatatgcactgtttataatagaatggtagtatagagaaccctaaatttcatacaatgaaagaccacttatgtttggaatgagttatattgagaatgtaataattgaatatagttgtatttgactttcaggtaatattttttcactaaatcagtgactaatgcaatctcaaccaggaagtagccagaaagctccttatttccttcctttccttacttgtcagtgatggaaatggataataaaatgtctcataaggtgatcccaccagggcacagccattctctctctgcgtaagcttgaacttgtctggctcacactccccttgggaagaagagaattaagctggggcgtaatgaagtggttctgtccagagaaacattcctagtggctgaattatgaggaggaggaagtacacattcctgtgtcccttttattccatgttggacttcgtacaacgtggagccacagccaagagatgggaataggaagtcctagaactttttgcaaaaagtctgtgctctctagctttcactactgaaagcttcaagatctgatgtggccatatcctcctgggcagctgaaaattgagtctgtgccaccagttgactgggttgccctccctgctgtgttgagatccagctctgggaaagtagcctcacatgcaggaagccagcatctttcactgccccttatctctgtgccagacagacaatgcagccttcttgacagacctattactaacaagggaggtggcccgtaggctagtcattaattcatctgatgcatattgtatgcctactgggtctcatgctccgtgctggggattcagaagtgaacctgcctaatatagtccctgccgtcatggcacttacggtccagtggtagactgataatgaccacactagactgataatgacattagtaatcaattaagtctgagacatgctacaacagcaaaccatgtggtagtgctgtgagcgggtgtaacaggggtcctaactcagcccaccctttgctgagcagagcatggcaaagagcacattccgcctgggaggccaccctagggagcaccaggcacaaaccctgcatggtccagacacgcagaaaactgatgggattgcatgcatggccttttgagggtagactctctgggcctgtggttgcttcatggctgaagtccagctccttgtgggaatggccatcccactggcactgtcgctgaccactacctgtgtttgggctggttcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttggtgagtgtttccaactcggaagcttcagggagtggacggtcctcgttcttcgttaccagaaaaagaaaggttttcttccttttatcagtgagtgtaatgaggatacagaaaaagtttccacacacacatttcttccccgacaagcatgtttgcctaactgcttcctaatgttctcatagtcatatatgacgtgcttatgcctggctgcaacaaaaacatgtgaaatttatttcaggagctttccaccatccttgccaatcctgatctctgcttctgcctgggctggggaggagtcacccccctgcagtcacttggtgacttttaaaaaatgtaccttctatgcctgcctgaaattgagggcaaatcacctttccaaggaacagaaggaagtggctctgcttccatgaacaggaagataaagttaaaattggcacatttctggcaccagcctggcttattatttaatttggggccttagatttgggttttgtattataaaagcaaatctctgcctcaatcagtcttgcttttctagttcccctttgagtagttgtggtgctttctgtaaagcttccatggaacaccatttccttttttagtgctttttctaattggcatgctagtcttcttttcttcttcgtctttctggtataataacaacctttcctgttaacttttttttttttttttttttttctgagacagtctggctctgttgcccaggctggagtgcaatggcacgatctcagctcactgcagcccctgcctcccggattcaagcgattctcctgcctccgcctcctgagtagctgagattacaggcgcacgccaccacgcccagttaatttttgtatttttagtagagatggggtttcaccaggttgtccaggctggtctcgaactcctgacctcaggtgatccacccaacttggcctcccaaaatgctgggattacaggcatgagccaccacacctggccttttccagttaacttaaactccacatattccataggtgttttgtttgcttgcatttttgtatataagtgcatgggtgtggacacaggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgtgtttcttgtttgcaaaaagtaactaatttattaaattgtgcttcatccagtgggagctattgagagttggccacccatagaaaattgagggaggattttaggaactgctgaaggtttctgccacatgcatgattctgatataccctggaagaatccatctgagccttccccacatggacacagagtgtggaatgctagcagcacacagagggtggcagagcttgccctgcacgtgacagcacaggcgctgagatgtgtcccagaaaaatgagcaggtagaagcctacctgagacatccaacagaaacatccctcttaacttccttcctcctttagtgttttgaatcagtttatttggttgggaagtgtaagcaaggatagtgtacagagaagtaggaaaactactcctcttcttccacctgctctgcattagcacaacaggacaactctcactgagccttcctgtcctgaagatttcttttttcttttcttttctttttttttttttttttttgagatggagtcttgctctattgcccaggctggaatgcaatggtgcaatctaagctcactgcaacctccaactcccaggttcaagtgattctcctgcctcagcctctcgagttgctgggatgacaggcacctgccaccatgcctggctaatttttgtatttttagtagagatggggttttgctatgttggccaggctggtctcgaactcctgaccccaggtgatccacccgccttggcctcccaacgtgttgggattacaggtgtgtgccaccatgcccagcctgtcctgcagctttcaaagtgaaccatcttcgtgtatgtataatgagtgggttgcattcatatcatgtgtgttttatacactgaggtagattccagttacgtaggaatatagttagtaatagtgtattcctgaaaattgctaagagtggttataaagtattctcaccaccaaaatgataactgtgaggtaatgcatatgttaattaactaggtttaatcattccacagcatatacttcaaaacatcatgttatacacaataaatacatacagttttatctgtcaatttgaagttaaggaagaaaatagattggattttcttacaccttttaaatgattaaatattataaaaatagaaaccaatcacatgagagaaacatttactactgttgttgataaaagtacggggagaatgtaacgcactttagagtgaggaagattctctggattctaccactgcatctgttagcgccatggcatactgtggtaaaatggcactgttttccgatgctatgtacagcaagggatagcgccctgttttccccccctagagctaccgttacaagcatttgcttatgttatagccttccaataactaatatgttgaaaacaccaagacaccacttaaggtctttacaaagtgagaaggaattgggaaaaaaagaaacaaaggccgggcacggtggctcacgcctgtaatgctagcactttgagaggccgaggcaggcagatcatgaagtcaggagttcgcgaccagcctggccaatatggtgaaaccccatctctgctaaaaatacaaaaaaaattagccgtgtgtggtggtgcatgcctgtagtcccagctactggggaggctgaggcagaagaatcgcttgaaccctggaggcagaggttgcagtgagcctccagcctgggcaacagagagagattccgttctcaaaaaaagaaagaaaagaatgtgaatattgacatcacattaaaaaataataacaaactttagccttgtggcctttttttggcacatgttttccgctagttctcatgcatcatccctattctctctcttctctgtcttttcttcatccaggaacagagaaagaggacttagaaggaactcaacccagtacttcctaggattggaaggaagctgccttatttcatgtataagtggcaccagcttgactgtaggaagagagatagcgtgaagcctttcacatctaaactagaaagcttttaaacgtggtagtttgttgagttattctctctctgtggaatgaatgatgtagagatggtgagaaatcagagtgggtgattttagacatttccctttaccctacttcattcctgctctgtacagagccttgtttctgttcttcaccttatttctttgagcaagagtaaagcctctgattatgaaaatacactgtgcataaatagccagaaaacacattttcttgcaatgaaagatttgttttatggaaaatctcataaacaccatcaaggaaggttttggaagaaggtcaaatgtccttcaaaatgctattaccccatcaccattcacatcttagtgtgactgacatccgttctcagctctggtggggagaggtggacagagacagcagcactgtcccctgtggcccagggttgcctgtggggacgcccacccaagaagcaggctggagagaagtgccaaggggttaaccattgcctggatgatattttgtcaggaatctaatgtttttctctctcctgtagggggtgacaggtgctttgacagttttgatgaaagatgcaataaaaccaaacctgatgcagaccctggaagtaagtggttttcttcttatagtaattgtttgcattaactggattgccacacaatgtgaacatttttagccaatatgaggcaggcatagagcatgcctggggcagcagtgtgctttgcaatctcaggcagaaagagtgaggatctggttaggaacctgtattagtccattttgacattgctacaaggaactacctgagactgggtaatttatgaagaagcatcagaataacttcttggccaaccaaaaaaaaaaatttttaagtgtattcatagcttctttaatataagtcatgtcttggcttaattgacccgagtagaaacttagaaagtcaatgtctgaggccaggcgcggcggctcatgcctgtaatcccagcactttgtgaggccgaggtgggcggattatgaggtcaggagttcaagaccggcctgaccaatatggtgaaaccccatctctactaaaaatacaaaaaaattagccgggcattgtggcacacacctgtagtcccagctatttgggaggctgaggcaggagaatcgcttgaacccgggaggcagaggttgcagtgagctgagatcgcaccaccgcactccagcctgggcgacagagcgagactccgtctgaaaaaaaaaaaaagagaaagtcaatgtctaacatttcaataggttgtatggccatgtttacaatttattttctgtgttcccttaatctctcataatcattgagttgtggattttttggtttgcttttttattgttgtttgtttgtttccaagcaaaatacaataaatgccaagactttccaggaaagcatttgccaaaggcaagtcaataaacacacagcatgttagttggtggtaaggtctggagaagaaaaatcagaggtcatgaggggcagagtgatgtggggtatgtgtgtctgtgcctgcccgcctgttaaagcagtaccagcacagagctgagtaaaccaagggggtgagccatgcacgtgtcttgaagaacatttggacagagggttacctttagtgcaggggccttgggcagcaaggtgttttgcaatttcagacagcaagagcgaggatctggttaggaacctgtattagtttgttctcgcattgccgtaaggaactacctgagactgggtaatttaagaagaaaattggtttaattggctcacagttctgcaggctgtacaggaagcatggctggggaggcctcaggaaacttatcatggtggaaggcgaaggggaagcagacaagtcttcacatggcagaacaggagagagagggcgaaggaggaagtgctacacacttttaaacaactagatctcatgaggactcactcacaatcatgagaacagcaagggggaaattcactcccagaatccagtcacctctccccaggcccctcctccaacattgaaggttataattcgacatgagatgtgggtggggacacagagccaaaccatatcagaaccaatatgacagaaatggggggattggccaggcacggtggctcaagcctgtaatcccagcactttgggaggccaaggcgggcagatcccttgaggtcaggaacctcgagaccagcctggccaacatagtgaatcccatgtctactaaaaatacaaaataaattagctgggcatggtggcacgtgcctgaaatcccagctccttgggaggctgaggcaggagaatcacttgaacaggaggcgaagattacagtgaactgagattgcaccactgcactccagcctgggcgacagagtgagcctcttatcttttaaaaaaagggaatagaaaaaaatggggggaccatttctgaaggtgcccagtgaggatgcagactgcaggtgtcccctgagctgaggaagggaggactgaacgcctttgaacaggtgtctgcagccccgggggaggggtgcaggatgcacaggtgccaaggccacacccttctgcggcaggttgtccttcccgtctttcctctcccctgatcattctgccagcatgcacgtatcctcagaggtaggccatcttaaaaagcaaacaaaaacatttcaaaaacctcctgcccccacctgcatcctcatctagcttctgcccagctcttgtctgtcactggggtctccatgttaactgacctcgggttccacctctcctgactgcccttgtccaggtcacttttcccttggagacaccaagtctttgttgctgtgccctcctcagagaagctcagcagagtttgacacagctgcccttgtcttccttcaggagcacctggttcctctggcgtctggggtccccccctccccaggcctgctcgctgctcctcctccgctttgctggcttctctgatgacccctcaccttttttgccccgttctcctccagaattagccaggtgatgactcccaaactcttgtttggaatatcatgcacctggaatttcagacttgcaggtatagttaccaggagccacgtgggtggggaaaagccatttcaaactgatacataaaccaggacccacctcctacctacttccttccagctcgctgcttccctgaaaccttcccagtcattcaaggcagaaacccgaggatgatcctagaggcctgttttcccttcccctcttcctgtgtccatccctgcagagttgtccttggttacatgactctgccctgtccacgatgctcaatgcctccctccttcctgctttagctgccagcacgccccacctgcacgagtgcagcagcctcccaaccagtctctctgctgctactcttttcttccaaaatactctctcctcagcagccatagagactgaaacctaatgaagccctgttgccttcctacttagagttcttccatgatttacccatgtttccaccccggtctgaaaagccctagggatctggctctcaccccttcccgctccttgtcccttatcctcatctctcatcctctgggggacctttgcacggctaacaccactacctgggccacttcctgatattctcatgtccagctccttcgcctccctctgttctcatgtcatgtaagcatcagctgctcagagaagccacaggaatgtgcagcccccgtccctctgctgtcattgcagtacatggcacagaatgctgagagcttcctatttccttatctgttttctgtatttctcctcccaccgagatgacagcaagaccttttccatcctgttcaccaccgtatctccagcttctagaaagtgcccgacacctattagaggttcagtaaagacttgttgaataattaagtgaatgtttattatttttactacattctcctaaaaatacacatttattaataaataactgaataagagaaaaaatacgaagtgatgtgatattccttcataacacttctccctcaaagatgaatacttattattagggataatcattttctttattgttgttgtttgttttgttttgttttgttttgtttttttgagacggagtctctccctgtcgcccagcctggagtgcaatggtgggatctcggctcactgcaacctctgcctcccaggttcaagcgattctcttgcctcagcctcccaggtagctgggattataggcgcctgccaccacacccggctaatttttgtattttttttttaagtagagatggggtttcaccacgttggccaggctggtctcaaactcctgacctcaggtgatctgcccgcctgagcccccaaagtgctggaattacaggcgtgagccaccatgccccagccaggataatcattttcttgttttaaataattctttttttttttttttttttgaaacggagttttgctcttgttgcccaggctggagtgcaatggtgtgatcttggctcactgcaacctctgccttccggtttcaagcgattctcctgcctcagcctcctgagcatctgggattacaggcgcccgctaccatgcctggctaatttttgtatttttagtagagacagggttttaccatgttggccaggctggtctcgaactcctgacctcatgatccacccacctcggcctcccaaagtgctgggattacaggcgtgggccaccacgcccagcaaatttttgtatttttagtagaggcagggtttcaccatgttggccaggccagtctcaaactcctgacctcaggtgatccgtctgcctctgcctctcaaagtactgggattataggtgtgagccaccgtgcccggcctgagcactttttaaaacataatctaaacctgttatttctttgctgcctaataaatcagagattcagaacccttaaaaagcaaataaaagtaagggcaataagacctgctgaggctgaggcaggagaatagcttgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagagacgggtttcactgttggccaggccagtcttgaactcctgacctcaggcgatccgcccatcttggcctcccaaagtacggggattacaggcgtgagtcactgtgcccagccaattgtaatgatttttatggttaccttttcttgaatggaatcatttcttaattaaaaaaataaatataccttttataccatcagggtttaatttcattcttttaaaaaaatatagtgcatggcaacataaaataaggtaaataatttatttcatggtcattgaggcaactaacaaaatggtttaacaatattttggaaggaagtgactgtattctcacagttttgtctctcaggttcagcattaaatgtagaataacatttttctagaatccggagggaatttggtcctttgattgagtcagggtgttttgactgtctttgaaatattttatgcattaaatatgcagtattcataaaagctttcctaccccatttgccccaaattgatcttggtttccatgcttctgtttgtcttttgggattttgatttgctttttcacttctctaggggacacctgtgttcgtgcatgcgggcccttttgctaacattgctcacggcaactcttcagtgttggctgataaaattgccctgaaactggttggtgaagaaggatttgtaggtaagttatttcttttaaatttagttgttgtagaatattgaagaaatctaaaagctgatgactggaatggagtgatatccatcctgacatgaaacatattctttcaggcaccctctttcatagagggtctcaataatggaaaagccctaaggtctggtctatactcgtgaaattatgcttgtgcttgaatcatagagtctggtatcaagtacatatgggtttgagtataaactctgactcttgcaaactgagtgacattggacacattttaattactactgagcttcggttttcttgtgtgtaaaatagtgataacaatactgtatcaaaccttttagggttgttatgaaaactgaatgagatattttagtcattcagcaaatgttttttgagaacctaccacttagaaggcatgttagctagggatccagtggtaagcaaaacagataggcgcagtggcacatgcctcgctactcaggaagccgaggcaggaggattgctcgagcccaggagtttgtgtccagcctgggcagcatagaagaccctgcctctgtgaaaaaattaaaattaaaacaaccagccttagcccctgctcctgtggagcgtactgtctaatggtaattgaataagagaaagtgctcattgactgtcagccattactacccttactatgtagtactgataacttgaagtcgtgggtttatttccatgtacagtttctccttgttttttgtgagctaatataggagagattcccaaccagtagacttagaaatgttaattggtagtactgcacaccttttgctgctgtcaagttctttgcagaacctgttcctctttggcttttcttgcatattccagctagaaagaaggggcaactctcatagagtttactaagtcagtgccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttcttttttctttggatctttttattttttggatgattttatttatagttgttataaaatacacgtaacatgaaagttaccatcttcaccatttttgagtgtacgttcattagtgaagtacaccttcattgttgtgcaaccaagctgcagaaccgaagtcccatgcccattaaatattcctcattctccagcccctggcagtgcccttctactttctgtctcaatgaagttgactcctggataccccatgtgagtggaatcatgtagtatttgtccttctgtgactgacttatttcacttagcataatgtcctcaaggttcatccatgttgcagcaggcgtcagaattctcttccttttttttttttttttttttattttttgtgagatggagtttcgctcttgttgcccaggctggagcgcaatggcacaatctcagctcactgcaacctccgcctcccaggttcaagcgatcctcctacctcagcctcccgagtagctgggattacaaacatgcaccaccacgcccagctaatttttgtattttttagtagagatggggtttctccatgttggtcagtctggtctcaaactcctgacctcaggtgatccacccatatcagcctcccaaagtgctgggattacaggtgtgagccaccacacccggctagaattctcttcctttttaaggcggaataatattccatcgtatggatagaccatactttgtttatccactcatcctacattggacatttgacttgtttccacctttggctcttatgaataatgctgctatgaacatagatgtacaaatatattttaatgtctaaaaatcgtgctctatgatgtctaaatatgtgatggcaatgacttatattcacaaatacgtaccacggaactctagccctgtaatgttgaactctcccgaaggtggtgtgtccatgctgtggctctgttggaatgctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctcccaggtcagccagcaccatcctttggcatgtgagcaaattgacaccaatttgaggcccgaaacaaaagtgagacaaaaagacgttcatttcaacatccttctacagaagttaaatagagtaggcacatctgaggtgtatctgaagtctgagcaggaattcatgttcttcaaaaagttgtcgtttatagtagactatctttatgacctcataatagggaaggatctcttaaaatatgaaaagctcaaaccatagagaaaaatgtcgataatttggcctgcattaagaagtaaactgtatgtgataaaagatacaaggataaaaaacaagtgacagattggaaagaaacgtttgcaaagatagtagacaatgattagcattgagaatatgtaaaacactaaagactaaagactgataagagaaagacaaataatccaatacaaaaatagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaatatgaataagacaggtttcttgccctccagtaattgatgatgtgctgtgagagacaagaacttcaatggtaagtacaatgcacttgattaagtactatattagttaaggttcttaactaagaatttcaagggatgatgggcatctcttagatagaactgtctccatattactggttttgctgatttagtctaatttttgttctaacaaaaagcatacacaaggaaggaattattttgtctattctgaataattagtctaagataatagaatcagtagtccatttagacttaaaacagagtgacatttattttaaaaaagcatgaatttgcaaaacactttatgagaatttttcaaaaactgctgtgatcactgttgtggctgtttcttccgttagtcagcagtcctcatgggagttcacctaacttccatttacatgctgtaaaggcaaacagatatttggcatcgaattctaatcatgtattacatttaaaaaataaagcaaaaggaaagaaagaaaggaaaaagcagtattgagttcctggattttaaaaacattattatctcatctttaaactatttgtaggaatttcaaacttacccattaacttaggattttttaatttgttttctgctctctcagttggttttgattccagttttcagataaagatcttgtctttgcagaggagtgcagaatgcaattgtgtatccttataggcaggtgtcattaactgagggtcaccagccactggtggactcctggatagacttcgatctacaactctgtcccataattaaatataggttcgtgcatatggagacatatatatatacaccttttttttttttttttgagatggagtcccactctgtcttccaggctggagtgcagtggcgtgacctcagctcacggtgacctccacctcccaggttcaagcgattctcctacctcagcctcttgagtagcttggattacaggcgcatgccaccacactcggctaatttttgtattttcagtagagacctggtttcaccatgttagccaggctggtctcgaactgacctcaggtgttccacccgcctcggcctcccaaagtgctaggattacaggtgtgagctgccgcacctggccaccttttttttttaacctggagaaaattacacaattcttggattctcacaggggaccatgacataagagagagaaagaactgttggtgcatatctcaaagcctagctctacttttgacggtagctttcgatgtcccatacacatttggcatttattatccttatccagaggtgcttgtcaagaagctacctaattgattgcaactctgctgcttgctctctgtagagaatcacacagacctggctgtgttccccaggtgcttcctgggtacatgagcataaacactcatgcagcagaggagaaatatgagacaagtgcccaattaaaacacagggtgatctttgcctcagacatttcaggattaggatttagaaatcagaatgaatcgacttagcagttccaagacaaattgaatgggattgggaaacaaagccttgttaatattttcattaaaaacgcccccgtttctgagccattcctgagcattagaccggtgctgagactatcatataccttctcactcaatccttaaaaccgtctgtgggatcagtgttactatcctcatcttacagatgatgtaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctctttacctggttgccaccctctcccattaaaaaataattttagctgggcgcagtggctcactcctgtaatcctagcactttgggaggccgaggtgggtggatcacttgaggtcaggagttcgagactagcctgaccaacatggtgaaaccctgtctctgctgaaaatacaaaattagccgagcgtggttgtgggccctgtaatcccagctacttgggagggtgaggcaggagaatcgcttgaacctgggaggcagaggctgcagtgagctgagattgtgccatcgcactccagcctgggcaacaagagcaaaactctgtctcaaaaaaataagaagaattttgggtgagctgtctacagcagatggtcacagttacaggaagtaccaatataactatattgtaccaatatatcgtaatgtgcgccaacagtggtggtcctttttggtcctttttttcttttctgtgttctactttaacatttcttcctcccaagtaggttactgattgaagatgaccttatcgagtcccactgtttccttgctctacctctcaacctgtatttttgggggacagttttttaatttttttattttccttttttgagacggagtctcactctgtctcctaggcttgagttcagtggcacgatcttggctcactgcaacctccgcctcccgggttcaagcgattctactgccttagcctcccaagtagctgggattacaggcacgcaccaccatgcccggctagttttgtatttttagtagagatggagtttctccatgttagccaggctagtctcaaattcctgacctcaggcgatccactcacccctgcctcccaaagtgtagagattatagctgtgcaccactgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccacctttaaaaaaaaaaaaaaatctgacgtcaagtgatcctgcagctctaagctgtaattctcccagaccttgccctgtttacattatttaaaaacactgatctcagcctgggctccacttttgttattatgatgcttccaggttttttgtctttagtaaatttattcataattaaatcaaggttgagaagtgctggcttattagagactctggctgaaggtcatgtgcgaactcaggaaactgctaatcacaggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgtcctttgaaaacaaatgaaaaagcaaaatgttcttcatatacactaaacaggaaagtatgcaaagtaatgttacaaacacccatgttcccaccactctgtttcatcaaaatcttaacatgtcgctgtgtgtcctttagtttttttgtttttttaaagagatacgtttagctgggcatggtggcgcatgcctatagtcctagctacttgggagtctgaggcaggaggatcaattatgcccagcagtttaattctcctgggcaacagagtgagaccctgtctctaaaaaaaaaaaaaaaagaaagaaagaaaagaaaagagagaagagaagaaatcagatattagagacacagttgaagttcccgtggaccctcctgatcccgttcttttttctgcttctctcctgatttgagtgattatcgtttccgggtgtgtgtttctactttgaccacacacatatatgtacactagagatctgtagcggaggttctcagactttctctgctcgtgaccattaatggcccagcaatttttttcatggtaccgcccgggcaagagaaatacctaacatgtccatttattaaataggtccaaacaacttaatgagtatttatgtccttacaactaagtggccacctgaaaaaaaaatacatatgaattcgaaggaaaaaataacatcatttcatttttaaattaccaccatatgttatgaatgagatgtgtgtccttgtcaggcaccagacaacttctgaccctttgtaaccagttgacacccgcacctcatttcctgttccacgttgattttcacacgatttttgcattttgctgcggtacctgccaaaaactttgctttgcaaatatatgatgtcatggaaagggatgtagagcactattgttgaagcagtgaaaaacctcacatgagtagtatttgcagtgtccaacggatgtcctgtattaccgcgtttccgtcaaaaatttaaaataccccacggtgcctctgagtttgctgcaatgcctcacggcacctcattgcacattagaatcacagatgtgcggcttttcttggtattttttatgtgttttcaaattttatatattaatagatattaactgactgcattgttctctaatgaggtcactgcactttttctgtaaatggcaagatcataaatagtttgggtcacagagtctctgtcccaagtactcaatttagaaagcagccataggtaaagcatgaattcataaactagtccatgtttaggaatgagtctggctgtgttccaacagatgttattattggttcctaacatttgaatttcatataattttcacgtgtaataatactcttctgatattgttggcaacattttaaaaggtggccaggcacagtggctcatgcctgtaattccactgcttttggaggccaaggtgggaggattgcttgagcccaggggttcaagaccagactgggcaacatagcaagatcccatctctataaaaaaaatttttaattagccaggtttggtggcacatgcctgtagttccagctactcgggaggctgaggtgggaagatcacttgagtccaaaagtttaaggctgcagcaagctatgatcacacctagctacttggtaagctactatggacaacatggtgaaaccctgtcttgaaagaaagagagagagagagggagagggggagagagagagataatactttttaaaagagaaagaaagaaaagaaagaaagagaacactttttaaaaggataaataatttttaaaaacttaataatttaacatgtaaaaaaaaaaagatgtagaccatatacaaaacccagaggcacctggatttgtcctgctagccatactggccaacccctgctctataacttgatatttttgtgcaacataacagttttgcatttctctatgtcactgtgatccaaaaagcctcattttgcctgcagtttagccttctgtgcgtgcatgtagcacgtgcatttgtgcattatttgtcaaggggctttcagattgcttccagtgttctgctgttacaaataatgctacgggggacattcttgtccatgtctctgagatttagtctaaaaggtcttctagggactatatacaggagtgagatttggggggttaaaagtacgcttagcaacaacttaatagataaagccaaattgttctgcaacgtaataccaatttatatcactaccaattgtgtgtgtgagatttctgacctctccacgtttgtcctgacacttcttttttttttttttcttgagacagagtctctctctgttgcccaggctggcgtgcagtggcatgatctcagctcattgcaacctccacctcccaggttcaagcaattctcctgcctcagcctcccaagtagctgggcttacaggtgcacaccatcacacgtggctaagttttgtatttttagtagagatggggtttcgccaagttgaccaggttggtttcaaactcctgacctcaggtgatccacccaccttggcctcccaaagtactgggattacaggcatgagccactatgaccggctgaacgcttctattgttagatttttttagctcttgctaatctgatggtagttcattatagttgtgagatttagcatctttatggctgtttctgggcatttgtgaattgtctattttgtattgtgctatttacctttttcttactaattaatggaaatcctttatagattccgaatacgaatactttgccattatgagttacaaatatcttctcccctgtatggcttatcttttaaatatgcttgttgtaccttttcttgtccacccttttctttatgatttctgcttttggaggttataaagataatcatttgtattgccttataactgttgtctcttgcattgaggcctttaatcatcttagaatttgtttgtgtaatggtgtcttttttccttaactcttacagtttgtgagacttttctgccctggtgatatgtgcatcagtggttgttagcccagccctatgaaaagggccagctggcctccatagatctaaggcagccgagagtgctgtcccctttgtcccaggctctgcagcatccaaggcgagtgcagatggggccagctgttcttccaaaaccatcatctcttctttacctgctccttctgagcttcacctgacatggctgtgcagtccccaggaaaaagaaagtctctcttgtcttcctacttcctaagtcaatcctaggaactgttacgttcaattccaagcagttgtcataaaagaagtttccttggaactttgaaaacaaaagaaagggtttaattttcttcttttcgttttgttttgttttgtttttaattttttgagacagagtctcgttctatcccccaggctaacagctcactgcaacctctacctcctgggctcgagcgatcctcccacctctgcctcctgagtagctgagactgcaggcacaatccactacacccagccaattgttcaatttttttctggagatgaggtctcactacgttgcccaggctggtcttaaactcctgagctcaagtgatcgcctgcctcagcctcccaaaatgctgggattacaggcatgaaccactgcgcccatccaaaaggatttaattttatggtcaaattctacattgtctattgactttaatatttttataaaattctttaaataaaatgtctttacctggaataccttcaatgtacttactggattagaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgacagagtgagactctgtctcaaaaaaaaaaaaaaaaaaaaagaaagaaagaaaaagaaaactctcctttgaattaaggtaatccttcttgaaaggcttgtttaaaatgtttccttgttacctgggagagagcaggaagcactgggaaatagcacgtcactggtgcctcgtgccatttccgtgcctttccctgtcttgcctcagccttgcactgtggaatgcaaaagagtagaagaaactccaacgtgaaaattgtcgacaaacaatgcagagaatcttcggtggcattaaacattaaaattaaagacacatggtcttaaattcagctgatatacttgacacctcagatatactcttggtgccaaaagggatgttaagcaaaatttgagggatttgactccttatttgggaaagaccatgactaccaaggggagagaaaccagaggcaaaccttattgaaaaatggagtagctaagtcattttgtatatgttacttttacccagccaagtacagtctgtagttttacacagtgaatttgatctttactctaaattcttttcctttaatgaaagtgctagtcagtaatgcagaacttgggcaagttttataaatatgtttgctttacaaccagtcttattaagtcagggtatcatctaagggcccaatcaaggacttttcatttaaaaaagaaaaactctaaattgcattgtgatataacccttaaattccaactgtcatggggaatcccaagacctacatctgtatgtatgtgctgtgttctaaacactgctccccaacctttttggcaccagggaccggtgtcttggaagacaacatttccgtggttttgggattaaacggttccacctcagatcataaggcgtgggtcctagatcccttacatgcgcagttcacagtagcattcacactcctatgagaatctaatgccactgctgatctgacaggaggtggagctcaggcagtaatgctcacttgcccgctgctcacctcctgctgtgcgacccagttccttacaggggctgcagaccagggggttaggggtctctgtttttgtttttttggagatcaagtctcactctgtcgcccaggctgaagtgcagtggcacaatatcggctcaccacactcttcacctcccaggttcaagtgattctcctgtttcagcctcccaagtagctgggactacaggcatctaccatgcccagttaatttttgtcattttagtagagactgagtttcaccatgttggccaggctggtctcgaactcctgacctcaagtgatctgcccccctcagcctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagctaggaatattgggaaaccagccattgctaaaggaagatgcatttagtgtatctttctatgtacctcttaacatcttttgtggggtgtagaaaaacagattattagggctttctttttttgtggggggggcgggagcggggatggagtttcactcttgttgcccaggctggagtgcaatgatgtaatctcggctcaccacaacctcctcctcccaggtttaagtgattcttctgcctcagcctcccaagtagctgggattacaggcatgtgccaccacacccggctaattttgtatttttagtagaggtggggtttctccatgttggtcaggctggtctcgaactcctgacctcaggtgatctgcccaccttggcctcccaaagcgctgggattacaggcatgtgccaccatacccagctaattttgtatttttagtagagatggggtttctccatgttggtcaggctggtgtcgaactcctgacctcaggtgatctgcccacctcagcttcccaaagtgctgggattacaggcgtgagccaccacgcctggcctattagggatctctaaaagccgcaagcctcttgctagccatagctgtgaatgttgtcttaaccattaatgcttcagtataaataatatcaatttaaaagctgcctaagatttaaaagtactatgcaaattacaaactgcttgggtatctagatcaaaataaagcagagcaaagaagtaactttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtctcaaaaaaaaaaaaggctttttcaagaaccatgatggatgattaaactaattgtaagtatcagaacaagataaccctatagcaaaacagttaatagcagaggaataccctggagtgtcctgagatagatttcttccagtagtaatttgataagatgacattttatttttatttttatttttttcttttcttttatttttttgagacagagtttcactcttcttgcccaggctggagtgcaatggcgtgatcttagctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcctccctgagtagctgggattacaggcacatgccaccatgcctggctaatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagcaaaaaaaaaaaattattgttggtatcctatcaaggctagtaaaaagaatagataaatgtatacatggaacatgggaaaacattcacaaaatataaagttaaaaaaatcaggttgtaaaataatatatctccaatttgtatgagatttatatctatatatggaatgaagagatatagaagtatatcaaatgattatttttgtttgcctggaggtaatggaatcatggtgattttcacttcacactttgtgatttggcattctcaaatttttacaattactgtgtattacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccaacaatgctacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaatttagataatttgggtgggtttttttttggacagtcttgccctgttgtccaggctggagtgcagtgatgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagccagtctgggctggtttagcaactccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgttactttttgtcctgtaaaatatgcttaccaggccgggcacggtggctcacgcctgtatcccagcactttgggaggccgaggcaggcagatcgcctgaggtcgggagttcgagaccagcctgaccaacatggagaaacactgtctctactaaaaatacaaaattagccaggcgtggtggcacatgcctgtaatcccagctactaggaagggtgaggcaggagaatcacttgaacctgggaggcggaggtggcggtgagctgagatcacgccattgcattccagcctgggcaacaagagcgaaactccgtctcaaaaaaaaaaaaaaaaatgcttaccgggacatctcaaggacatcattcctttgtcaacggtacaaagataacctgagacataaagtgaaaatgatttatggttttttgttttcttccttacattaaattttccaataacatatcgctaataacatatttcttttgttttgagacggagttttgctcttgttgcccaggctggagtgcagtggtgcaatctcgactcaccgcaacctccgcctcccaggttcaagtgatttctcctgcctcagcctcccaagtagctgggattacctgccaccacatcaggctaattttttgtatttttagtagagacggggtttcaccatgttggccaggctggttttgaactcctgactttgtgatccacctgccttggcctcccaaagtgctgggattacaggcgtgagccacggtgcctggccaacatatttctaataatatattaatttgataaacagaagttattttggaaataagccaaaacaacaaaaaatgctcatccctgcttttcaaggctattatctgtagtttgaggttttatcaaatgtagatatgaactgcgggcctcttcaggatgtcctcattgcttctgttaatgcttttaccatccagtaccactgaacaggcagcagggtgccttcttgggcacaccggaaggacccaggaaaaggaagatagtgtggcctgttcttgtctccatgccccaaaatggaccactacaccagtggggtaggaaatagcaggtgtgttatgggttgagtttggagaccttgacttgatcaaccatctgctcacccaggtcatctttcctttttttgcagaggtgaggtctcactatcttgcccaggctggtctcctgggctcaagtgatcttaccgcctttacctcccaaagtgctggtattacaggtgtgagccaccatgcctggttcttgtcaccattcttaacatcagcagcagcagaaaaaccccctgtttagccttcaatgttaatttcctccttgatctatgtgttctacacaaaccactcccttgttgtcccccatatattacatttgtggactcttctcaaactctgcagctcagccctggttcctgctgagcctacagccccaggcctgagcagccggctgggccaagttaccctcagtctcaagatgacttcctcacaaggcaaaacatttctccagctgggttggagacctaagctggggaactgggctctcacattccaagatagaggtttgcctatggacccctgaaagtaggcgtgtagaagcaggttcctctgatggcagaggccctctgtttatctctgaaagatcctgaatgctatgcttctttcatcccctctgccttgaattcgcctgctttctaggtgcggtggagaaagctgggaaaagagccacctctgctcccaggggccactgagagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgctacatttttgctgtccggctccaagtctgtgacaatgggtcacgggatcagtgcgagtaacagtgaagatgtttttcttcatctttgggctatgattgtgctttgtgatcctaagtataaatacattgaggctgggcacggtgtctcacacctgtaatcccagcactttgggaggccaaggcaggtggatgcctcgagcccaggagttcgagaccagcctgggcaacatgtcaaaaccccatctctacaaaaaaaatacaaaaattagccaggtgtggtggtgtgcacctgtggtcccagctgctcaggaggctgaggtgggaggatcacctgagccctggagatcaaggctgaagtgagttatgatcgtaccactgcactccagcctgtctcaaaaaacaaaacaaaaaaaatacatacactgactaataacaccagcaatattgtttcatgggagctgcctctgctgtttgtaccaaaactgagcagattctttaggccaggcccgagtaatcattaaatcgatctgcttgtgagaaaccggtaggtctaggcatgagcacaaagtggcaggtccgtctcttcccttcttaaataaggaatcaccagaggtagactctgtgcctgtgactcttgaatgtttaactgaaatccagagcagcaattgcattttatatgacaccatgtgtgtgcaaaaactgaatcaaaatcttgtgaaacagtgctactttcacttactatatatgatgtagtctaataattttctatcctattttatttcctttttttaaatgctggttgaaattctgtaaatttatataatgacaaactactgggactctatcttggttcaaaagtccatgatcagcctgcttgtattgagttactacattgtacgatcttataattgtaaagtttaagatattttccttctgtctgtcttaatttattctgtaatctaagttgtcctgccaggaatgctggcatatttactttgtttttgaattcaataatcatagtttctcttgctaagttacattaatggtaccaaaaaaaagttactgcatggtttttgaaactgttctttcctaggaagttttaaagtaaaatgtttttaccttttattgtttacacaggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaacatgggaactatttggataatggatttatgaatttaattctgatggatttttataaaggagctaaaaataagcctatataatttattacatgtataatcatataattttaaatgtgtataatttataatattcatcgaaacatttctttttggaaattaaatttcactttggtcaaaatcatcttacaaaacaagatgactcatgatggttctaaataatgtaaaccggtgtctgtaactaattaatgctctggaggaaggaaattctgagttctgacacaaaagcacgtctaagtggtattggtattttcaaagcttttactacaaccaaaaatatgttcacgtgtacctgtctcctctttacactgcttactttctctatcgcttttcccaaatacgtccccagtaacttcctcatgttctgtgcaccacctccaatcttcccctaatgtgtatgaacttggtcatcaccaaagaggtggaaaggaagaagggcatgtgctaatattaatattgaggtttgggctgggtgtggtggctcatgcctgtaatcccagaattttgggaagccgaggcaggtggatcacgaggtcaagacattgagaccatcctggccacatggtgaaaccccgtctctactaaaaatacaaaaattagctgagtgtgatggtgcacaactgtagtcccagctactcgggaggctgaggcaggagaattgcttgaaccagggaggtggaggttgcagtgagccgagatcgtgccactgcactccagcctggcaacagggagagactctgtctcaaaaaaaaaaaaaaaaagaaaaaaattgaggtttgtgccagtttctttttcctttaggtctcctgatatgtgtctagttagttctatatacttcctggaaattcgactccaagatatttaataaaactaaacagggttatatgttgaatagacaaatcctaaagagcagaaaggatttagtggttagtgaaatttcattgacttaagatgagttggatcctcaaaattaatatattctaaacaaagttctatttttaagctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaataatttagagctacttgttaaatgctggagtattattgaagtaccaagtgttaagattttcactgaaagcaaaactgaccaagcagctcagctagggaaatgctatgtgatcagttgattgtttgatgaggagtatggagcagggactttggcagaggttgctagcagacaggccttggttttagtccaagctctatcgcttaatagctgtgtgaccttggggaaaattataaaattttccagtccttagtatcataaactgtaaatggaggagaaagatgcctcacagatgttgaaggtgaagtgagacaggacacctagtacattgcctggctacatagaaaatgtttcacaaatgttaacttgaggccctctccccatgcctcggtctcttagaatggtttttccccatcgtgtgcacattgagcggtaaggcggacagctgccgccgcccatgctgccccatgttgagagcatttctgttgaccttcccttcttccctgtgaagctggttcagcagtcacctcatcactgtttttcttctccagagagtgctgggttgtagcgaccatactgttgacgcaacacatcccaaccacgctggacggaatttttactgcgataattcatattccaggatcttacagtgcacagggttacaacgattagcataatgatcttgcacaatctttctgcctagcatgtagtgcattcgtaatattctcagaggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcacccgtggatgatcatggaaaggcagctgcctggctttccagaattgttttgactctccatctgaacccagagctctgtttcctgtacaggttgctagcagtatttacccaaattgtcccttcccaactcagacccactgacccttcctttctcagctgattacgggtttaagtttgaatcaaaccatgctatagaatcactatctagcagcttctgtgcttgcacaataagagtattagtcagcgtttcctgttttcattcatattgtaagttgaatagctgtaacaaaagggaaagagattgccaagacaaataattcttatggcttgtgcaaacaatttattacaagccttattaaatatgcagctttcagaagtctacgtgatatgcctttcagcaaagctaaatcctactatgtggacttgcttcatgacttaagaacaagtctatattgaatttaacattaaataattatttggcctgtatctcttttaagctttgttaagaactgcaaatatgataagggaataaattgctcatttcaagtcactaagaaaacctaacctataggttatatatgttggcagttcccaagaagtacctaggaaatggaaccttcctataagagtggtttgtccccttctcacgagatgggtcttcatatcaaggccccctaaggcacagatacacagcactccacagtgtccaagttcgtagtaattggtggcaccttattaaagtagtttttactttcataattactgattacacatcagcataccttttccatgttctgtttccttggcagcctgatatttgaatacaaacgacataaaagtgattacatgcagcatttcaggacagttttcaaactgagagaatttggcactttcttttattttcttcccattcttcgtctatttcctttgcatttggaagccaaactcctcgaacctttacttctgcatgttgttttcgtcccctagctagagttctctttattactacttttttgtttccaattggtctctttttaaaaataaaacatggtgaaaccccatcaatacaaaaattagccgggcatgatggcgggtgcctgtgatcccagctactcgggagactgaggtgggagaatcaattgaacccaggagacggaggttgcagtgagctgtgatcgtgccattgcactccagcctgggcgacaagagtgaaactccgtttcaaaaataaatgaataagtaaattaaaatatgaaattaagcttagctagcctgtgtagatgttttagatggtcatatctttatcggatatgacatttatgcctttcagtaaaaccattgtagtattgtaagaaaaaaagggaagtatgatagggaggactaagaacatatttgtacttctatgtaatgctattttatgtgtctatttccattgaagtgtggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaagaacttagagatcacttgatcagcccccgttatgtaaaatgtatgcaacaatctacctccaactatagggcgacattaaacagtttttcaaaataccatggcattgaaaaaaatgcgtaacatttgggttacttcagtcccactccccggtactaatcaggccagtgaaccagtcttgctggtgaaataatgacttctccagtcatgatggatgatttcccttcatcatgaccatttcttccctggctctgcctttacctatgaatctcttctttcctccctctccttcctcctcttggtctctgcctgccatacccaactccacatttctctgcttggaaaaatcctacttgattctcagagcctgactccatcaccccctctctccaaccctcccaggcaaactccgtccctcccagtgtgccgccctccagctctctctagttgaatagcagatgttctctctcccacttccctgcagggcttcagggtagtgaccctaagagtgagcttctaccagtgagaaaaacgcctggatggagcaggaattcccacaaatgcttaggaattcaatatgatttttagcaagtgggagaattatccttttggttacaaagatgtgaactatttttgtgagttctcagtatgcaccaagaaaaaccccagtgactcagtaatgtacctgtgccgtctcacttaacccttccaacaaggaacttgccaaggtgcacagctgggagggatccggggtcccgtccgtgtgctaacctgcaggacagcgccgcataatccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaaaaaaaaaaaaaaaaaaagagtaagaaaggatcttccattgtaatcatactatcattgccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaagtgcccacaccgccttcctaataccaaagaaatttcattatgttaaaacagaattgagcatttgaaaaattcctgcccatttaatgactatagttttctagagtatttttcttaaaactttttttttcctgtagacctccctcgtggacatctaaaacgttttttgttttgtgttgttttttgttttttcccaacaccaccatagggcactttgagtttagtaagttcgagtaaacagtaacacccacagttctttctaaacaatattttggaaaggagcataatgcaaccactttttagtctcaagcttcacatctgatactcaggccaagattgtataaccatatggtaatgggaggttagaggctcttgtccctgaacgaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgagacgaactgccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccagtggtggcgggcgcctgtaattcccactactcaggaggctgaggcaagagaatcgcttgaacttgggaggcagaggttgcagtgatctgagattgcaccattgcactccagcctgggtgacaagaacaaaagtccatctcaacaacaacaacaacaacaaaaaaaaaaaaaaaaaaaaaaaaaaaaaaaaccagcagggaccaggaagccctgtgaagctaggcatccctctcctgggctccagtagtaccttctgcctcacattgtttcatgaatgccttgttctgtgtctccctatgtaattctcaattccttgagtttagggactgtgtcttattaattggtatggtccaagtgtctggcatggtctatatgcagggagtgttttcaataatggcaagataaatgaactttcatcctcttaatcctctattccatagtgctcatctcggtgtccttccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgtgattgtgccactgccctccagcctggacaacagaactttatggcaattaccgtaaaatgatttcgaatggtgatgtactctgtataaatcaagtattaaacatattattagttttatgttctaatttgaaccaatgtttgagaagtttcatactgttccattggctcaaattagaatcatccagggagattttaaacattactgatcccaggttcccctcccagaacttctgctttcattggtctgggtggagcccagggatcagtgttttctaaaagcttcccgcaggagtttaggtttagccagtgctgccagctactgttttaaaagcacaaaacatagaggtacatttctaaaaattgaatgtgattatgttgttctttctttcagatcggttgtgtaagcatttttataggattattcttcatgttttctctccttatttcaggtaacggctggtgttcctcttaagaaagaatatacagaggaggtaagaggagctgtttagatgcttatgtgaagaatctcttaaatccagtgactcgttggctttcagtgaatgagccctccttcagtggcctcttagaaaagtgctgttctgtccgggcgcagtgactcacacctgtaatttcagcactttgggaggccaaggcgaccggatcacatgaggccaggagttcaagaccagccaggcaaaacccatggccaacatggcaaaacctcatctctactaaaaatacaaaaattagctgggcatggtggctcacgcctgtagtcccagcatgagaatcgcttgaacctgggaggcagaggttgcagtgagctgcgatcgcaccactgtactccagcctggacgacagagtgagactctgtctcaaaaaaaagaaaagaaaagtgccgttctaagaatccgagaggaaatggatgggatgaaaggataaaattcattcagttaactcttaaatatcaagaaaagatggatataggctttgtctactattgtgtactcccagggtagccatcagagcaggaactcaaggtctccaggtcagaaacaaatatgaagcttacacttctgtattcttttgtcatggaaggtctatatacagttggctttatgatttacaggagtggcttactcttttctgtaaatagactttgatttgctggcagcagtacctcttagctcctacaggtggcgccagggatctgagccaggaatacctggtcagagctcctcacccacctggggccttgtgcctgtcaggcctcaacctgcagagcatgggcgcattgcatagaccctgcagcctgtcctcagcagggtgagctgccaggcttcagacccacccatatgccattggatccagaatcattttagaaattattttgaagacgaacctctttattcttgcagccatctttcttggaggaaaaagtgaaaaaagatgtagcaaatcctgccagagaggtgctggcagtttagcttggcaggtttggtgggagacaatacacaggggtctgggttttgcttttttcttttttacagaacatccagctggtggcagacggctgctgtaacctccagaagcaaattcagatcactcagctctttggggttcccgttgtggtggctctgaatgtcttcaagtaagtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagcctgtgcttttgaagactcccaaatcgcagtcctaagtgaggaggtactttagcgaacaggatttgacagctgacgctttcaggagttgcacaggaacaagagcaatttcgtgaggattgggaaaccatgggaggtattttccttgttcatttctcttttttttttttgagacagtctctgttgctcaggctggagtacagtggtgcaatctcggcttactgcaacctctgcctcccaggttcaagcacttctctgcctcagcctcctgactagctgggattacaggcacctgccaacacgtctggctaagtttttgtatttttagtagagacggggtttcaccatcttgggcaggctggtctcaaactcctgatctcatggttcacccacctcggcctcccaaagtgctgggattataggcatgagccaccacacctggcctctgcttgttcatttctgttatggttcttttctcttgtggttttattgaactatgtctagtgtatgtgtgtgtatatatacatacataatatatttatttattttcattgtggtaaatatatatataacaaaatttactatcttagccttttttttttttttttttttttgagacagagccttgctctgttgcccaggctggagtgcaatggcgtgatctcggctcactgcaacctccacctcccgggttcaagcaattcttctgcctcagcctcccaagtagctgggactacaggcgcaagcaagcgtgcctggctaatttcttttttattttagtagagtcggggtttcaccgtgttgcccgggctggtctcgaactcctgagctccggcagtccacccgcctcggcctcccagagtgctagggttgcaggcgtgagccaccacacctggcccatcttaaccatttttaagtgcacgtcagtagtgttaagtacattcacattgtcatgcagccaatctccagaacgcttttcatcttgcaaaactgaaactgtacccactgaacaactccccatgcccctccctacagtccctgccagctaccattctccttcatttccatgaatgtaacaactccagggacctcatgtaagtagcatcatactgtggctggcttatttcacttagcataatgtgcgtgcatgttgtagagtgtcagaatttcccttcttttttttttttgagatggagtttcgcttttgttgcccgggctggagtgcagaggcaccatctcagctcaccgcaaccttctgctctcgggttcaagcaattctcctgcctcaggctcccgagtagctgggattacaggcgtgcaccaccacgcccagctaatttttgtatttttagcagagacagggtttcaccatgttcgtcaggctggtctcaaactcctgaccttgtgatccacccacctcggcttcccaaagtgctgggattacaggtgtgagccaccgcgcccggccagaatttcctttatttttcgggctgaatacgctcccattctttggatatcccacattttgtttctttgtccatctgtggatggacacttgagctccccctcacagctattgtaagtaatgctgtatgagcatgcgtgtttatggcatatggcatatgtacaagtatcccttcaagaccgtgttttcttttttttttttttttttttttgagacggagtcttgctctgtcgcccaggctggagtgcagtggcgcaatctcggctcactgcaagctccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatgcttctgagttatgctgtctcagacatgcactaaccctaacatgaacccttttcctttccactgatatttcaatttttttttctgaattcccattcttcatgcagataatgctgctaaaatgtcagctctcttctgaaaggaggaaaatgtttaataataatgtggtctaaagtcctctattgataggcgacctcaaggccaggatccctgcctcctttgccaacacacttctcgcttttcttgtaacagaaattcgatttgagctgcataattgtttgttagataatcagcctcccagcctactgcagcatgacagttcatgaaaagagctgctgctgctgctggctctctttgtactgtctgcctgttagctgtgttcctcacaccagcaagatttagatcatctaagaccatttacagtcttgtcttgtcaccatgtaaaaatctgaattcattggtgcagtcagtaatagagctcaagccttctttgccccggatttcttgcattgattggtgctggtaaaactttagtaacttaagtaatggttttctggaagccctttttacctcccctacaaccccacaccctcacaaccaacccttgggtgctgggcagtgagaaagatatggcattgctctataggagaaagaagttataaatgctttgcatatgacactctcccacctttgcttctcaaagcaaactgggtttctgtgtgccccttggtgtctccccagactttatatccccaagaatgtattcagtacaagactaatggcatcttgtgtgctattctttctccaccccagtcttgtggaaggaaaacaccggagatgatttagggtaatgggaaatagtgctagagcccagggcatgactgcatttgaatgtgaagtagaaattgtctcggaaccccactggagagtgattcagctggagagagtggggcacctggctctcagaggcactgtgcggccagacagcagtgtgctggacttcctaatggcgagctcacaggttaagtgagaaacaggctgcacttctgacttgggagtctctgctgaactttatagaaaactgacttcagcagcaactgctgtctagagaacaatttggcatctctttttgccagagtaacttctaactcaagagtaggcaacttttaattatggtaccggatggaggcagcaatgaataatttagaataaagattgaaaaatatggaataaggtgtagtagactaattgctcagaagaagttttattgtgtgaaaatgaatgtgtttaaacttgaaatacagaggatcatttcctctctacccttgagggtgattgcagtcccttttaagaagctgttaaaagtccccctcaagatcatcttctctttgaattttcctttctaatgtgacttttgacaattatatctttatcgttcactaagagaatatctccatgtctgcagggatgcagggaaatatgatggctgaaagaaacgctaatctacatgcgcactttattagctaagaaatccctcctccatacgttcttccaggcatgcctccgcacatcccatctgctatgtgggctcaactctgcattatagatgggaaggtgatggacttgtccataagaaatggacgcttgataggagaaggaacatattacatagagctaacaggctaaagctttgggatcatgcaaattaagtttaaaccttgagtaggcctcctactgtggacacaatttggggaagctgactaatctctcgagcctcagcatcctcatttgtacaatggtgtctgacagtgacaccaacttcaccaagttgctgtgagacccaaatgaaatgccccagagtaaaatgctggaacatagaaagcaggcaatgaaggccaggagtggtggctctcgcctgtaatcccagcaccttgggaggctgaggcaggtggatcacctgaggccaggagttcgagaccagcctgggaaacatggtgaaaccccatctctactaaaaatacaaaaactagacaggtgtggtgtcacgcacctgtagtcccagctactcgggaggctgaggcaggagaatcgcttgaacctgggaggtagaggttgcagtgagctgagatcacaccactgcactccagcctgggcaacagagttagactctgtctcaaaaagaaaaaaatggaggaaagtagtcaatcaatgctggttcttcctcctgtcatgttcacttggaaagagagtgggcctcctgaattcaccttcaagaattctcctgtaactcaaggtaactttgtcaaactccaagattggtttattttgctctgggttaaaaccaggaattagaagtcaagtctcctaaagcactactgaactaaaccaagacactgacgtttttccttctccgtgagaattgggagcccttagtgatatcataaaacatcagtcatttttgcaaagaaggaggtatgacccggagaagtcagcttgacattcagtcggaatattgtttgttaaatgaggagttaaggttgaaaatcatctctgtatccttcctctagccttgcaaacattttaaggtgtagccttgacagcaagacaggatagtgtttgtttttattaaaaggtctttcctgttccttgcgtgaagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggcagagtctcgctctgtcacccaggctggagtgcattggcacgatctcggctcactgcaacctccacctcccggtttcaagcaattcttctgcctcagcctcctgagtagctgggattacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaagtcagatttgtagaagaggaacgagcagatgcatcatgagaacactgtgcttggccaggcgcggcggctcatgcctgtaatcctagcacttagggaggccaaggtaggaggatcgctagaatcgaggagttcaagactaacctgggtgacatggcagatcctgtctctactaaaaatattttaaaaattagccaggcatagtggcacatgcactgtagtctcagctactcaggaggctgaggtgggaggattgcttgagcttgggaggcagaggttgcagtgagccaagatcaccccactgcattccagcctaagcaacagagccaagctcaaaaaaaaaaggccaggcacgatggctccctcctataatctcaaccctttgggagactgaggcgggcagatcacttgaagtcaggagttggagaccagcctggccaacatggcaaaaccccatctgtactaaaaatacaaaaatgagccgggcatcgtggtgcgtgcctgtaattccagctactctggaggctaaggcccaagaatcacttgaacctgggaagtggaggttgcggtgagccaagaacatgccactacacaccatcatgcccggcctgttttttttgtgtgtgtttgttttgggttttttttgagcctgggcaacagaacaagactctgtctcaaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgagtaagatgagacgcccctactacgttataaagccttcatggatctttatttctaacagttcatttttaaacttttgttccatttcattttattttgtccattttttgtcatcaaaaaattattttaaaatgtaacagctcttctagaatgtacagatcaattttattccactaaaaaacaggacttcaataatttaattgaagaattctagtgagcatttccagagcctttccaagaaagctatactgtttaactttgagtgactcagcttctaggaccctggtccaccacacctacaaaatgaatttaataaagcatgaaggtcaccaaatcctctactatttcttcgtggagtcattcagctagtgtttatgttgtgcctgctctgtgcgagagactgtgccaccaatataaccactggtcacagttattttctagagccatactgcctgatatcccatgtggctaagattgacagttcagtttctggattgttccagtcccatttccagtgcttttaatagccacatgaggccagtgaacacacgatacatcttccattgtgatagaaagtggcagtggacagctttgttctagagtatttccgtttctgaaatacatgtttaagaagtttggaaaggaattagtgtagagtatgagaagggttacatttttggtgaatatgaagatttaacataatgttagttcaaaaatgaccaaagacacaagtgtagacaccaggcttttgaagtagctaatatgttaagcagctgtgcattatatagacagaatattcactatgtcccactcagccctgtgtttgacaccatttcaccttggcttctgcctttctttcccttctttgcctattgagatttttcctgtcctttctatcctttttttttttttttttttttttttttgaggcagagtcttgctgtgtcaccaggctggagtccagtggcacgatctcagctcactgcagtctccacctcccgggttcaagtgattctcctgcctcaccctcccaagtagctttgactacaggaatgcgccaccactcccagctaatttttgtattatttaaatagagatggggtttcaccatgttggccaggatggtctcgatctcttaacctcatgatccgcccaccttggcctcccaaagtgctgggattacaggtgtgagccaccgcaccaggcctcctgtcctttctttaatgcactattccagctttttttttaatatcttgccagcttttgctgattttcatgcctccctctgcaacctgtgatctcttgactttaatagtaatgtttatacagagtcttgactgcacactctcttctgtcatcgttgtttgttgtgtctcattgtccccaatccatcagaagttcttggtacacaaagtccctgaagctgtatgaacaatgccctgacgtcttgaaaggacttgccataggtggttatttgatcacttagcagatgcctttgggatcctactttgtgcaggccactctccaaggcacaatgtggcaagtaaatatattagtcaatatttacagaaccaagagaaagccagcaatgattaatgcataaacagtcataaattggccattttatttgtttataaaagctatcatttactacagagaagtacaagtgaatatcaagctcagatcaagacctttggactgagcttggctttttttttttttttctttaaagattacacttctcccccaaatcaagcagattaaccataggaagttccttgcctgctaacagaatataaatagattgcatgcaaggggaaggaccttatcagggcagattttagtatttacactaaacccaaaagattatttccttaattgtacttgtgagtgaaaaacaaaaattgtagcaggagtcccaagagcactctggccatgggcttttgagctgtgagttgaagcactttattcagcatgtggctgcagggttgtagctcaggttgtagacagtgcattctcttcaggtcccaggaaacagtgtcatacctgtggaagccaccagaatgcaccttcatcttctccagtggtggcgaggttgaggccaagcatcagaagtgctgagtgctgggaaactgtggggctggatagatggcagtgcctgctgggaagcacacagccctgggttgaggcagggaagcagggccgcccagttgggattcattcgtactactggcccctcacagtaccgtcatgtgtgggtggtcgcgcttgtcctacaggaagtaaaccacaactactcatctcacacagtcagcccggcacctccttggaattcccaaaacactttccaataaacattggaaaggaagaaagtttagttggtaacaaaaaaatgtatgttgccttacgcccaaaagcattgaaagcagggactcaagcaggtactcatgcagccctgttgatagcagcattgttcccagtagctgaaaggtgggaacccccttgtctgtcagcggggatcagctaaatatggcacacacatactatggaacattattcagccttgggaaggacacctcctatcacacggatgaaccttgagaacattatgctaaatgaaatacaccagacacggaaggacagatactgcttgattccacttgtaggggcctgtagagccgtcacattcatagacaggaagtagaatggtggttgtcaggggccaaggggaggggcatggaaagttgctgcttaatgggtacagtttcagttttgctaaatacagagagttctggaggttggttgcccgacaccataaatggacttaacgctactgaactgtacacttagaaatggttaaaatggtaaattaggccaggcatggtagcttgcggctgtaatcccagcactttggaagtctgaggcaggcagatcacttgagcccaggagttcaagaccagcctggacaacatagcaagacccccatctctacaacaattttagaaattagctggtggcttacacctgtagtcatagctacacagtatgctgaggtaagaggatcacttgagcccaggaagttgaggctgcagtgagccgtgatcacatcaccgaactccagaatgagaccctgggtcacaaaaaaagaaaagaagatggtaaattatatgttatgtgtacgttaccaaaattaaagttcttaaaaatatatattttaggccagacacagtggctcacacctgaaatcccagcactttgggaggccgaggcaggcagatcacctgaggtcaggagttcaagaccagcctggccaacatagtgaaaccccatctctactaaaaatacaaaaattagccaggcgtggtggcgggagcctgtaatcccagctgttcgggaggctgaggcagaaagaattgcttgacccagaaggcagaggttaccgtgagccaagatcgcgccactacactaccagcctgggtaacagagtgagactctgtctcaaataaataaataaataatatatatatacatattatatagatagatagatagatttcttacaaaacattttcgtgtttaaaaataacaaatcaggccaggcacagtggctcacgcctgtaatcccagcactttgggaggccgaggcaagcggatcacctgaggtcaggagtttgagaccagcctgaccaacatggtgaaaccctgtctctactaaaaatacaaaattagccgggcgtggtggcacatgcctgtaatcccagctacttgggaggctgaggcaggagaatcacttgaacccaggaggcagaggttgcagtcagccaagatctcgccattccactccaccctgggtgacagagtgagtctctgtataaaaaaaatttttttaaataacaactcagccatccactcgcatcaatttattcactagtcattcgattgctattactttgctcccatgtgagttttttaaattattaacagaaaaatcacactctttatttttgaattatgatcttgagttcagtaaagaatgcattctgttgattaaatgtgttatgagtaacagtatcttgttttgctgtacttccaagcaaaatgtaattctttcagtcctccctaccgttctcactccataataatatgacttaaggtttgtatagcatgacgtttacaacgtgcttgcgttttacactgactcaacgtgtgcagtacagtgatgtatagtgaagtattcacatcctcatcttagaaatgaggaaataaattcagggaggttacatgatttaaccacacataaggaggggctgcattctctctgagcccttctacctcacacagccaccaagctcctttgtgcagagcccatggagggttggagtggccacactggggtaggtgcaggccagagactggatgcaacaggaacattgcctgcttcccaaaaccactgttctactgcccggagaacacacccttctgggagctgacttctaacaaagcaaggtccttggacttgccctgcggcttctttcctgcaagaagtatcttccagcatcctaccaacttttatttcttaaaaaaggttgttccttgccaggcattggttgatcagcagaggagctcgcattagtttcagtgcagtgttgggagcaagcacttgagtgcccagcaacataggctgctcatgatctaagattcatggaaaaagtcttctgcgctgttgcctgcagcacatcaacacctgaattttcttatcatcttgtgtggctattgaaccacagggaacccaagcttagtcaataggaaatatagaaatattcattggttcaactgtatagggagggccttgtatatattccaggggctgtatcctatcttgcctctaggtaaataagagatggtcccgaggctcaaagagtttatcaaccattctttattcttcagctaatatgaacattgaatcttttacattagaagttgcccatgcagggcacgcctgtaatcccagcaacctgggaggccaatgcaggaaaatcacttgaggccgggagtttgagaccagcctgggcaacatggtgagacctcatctctaccaaaaataaattttaaaaaaagttacccttaaatttctttctctaacccagcctcaactttgtactcaggcagtaactctttgtacaacattcctggcaccatattcagcttatacagaaccctccaggcaaggacaggtcactgctaagtgagagagctctggttattatagttcttccttaaacactgcactcaaaacgacttccttctaacgtttgtcccttggttcacattctgccctcctttcgattttttgtatggcatggccctccaagagatttcagtgtcagtgtggtgctgccaagtctgtgtgactgttcacacactcgggctccattcacacaccccaagattgcatgagcttttgctgcagccactcacagtcaggccccagtgaatccctgtcctctgaagctgcaggtaggagcgccccaagggcatctagatgtcaaagaagaggatgctcacatgtgcctaaggttcatccatgaaggcttcgtggaggaggtggcttttgggatagatcttagaaagctcagagagttttaacaaagattggtccttgaagattactaatcttttgactttataaatacttgcatatatcttcttccagtctgtctcttattttttgaccttatttataatgtcttcttaaaacaagttttaaattttgctgtagtgaaatctatatatcatttcctttatgggttattctattgttacctcatttaagaaatccttctctacttcagaataatagagttcccactgttttcttccaatatgtagagttataattttcaagtttatgcctttgttccatattgggtttatttggaggcctggtatgtggtaggaatataattttatttctctccagccaaaagtcagatggtagtcagcctttctctgttgatttgtgtcacctctgttatatactatcctgcacatgctgagtgtctttgtgggttctttcttcttttccgttgattaatttgtctatacttgtgccagtacccatggaatttattagcatagttttgtggtatgattgatagctagtagaaaagtcctctttctttgttcttttggttttgttttatttttaaagttatctgactatttatgccattaccctgtgttagttcactctcgagttgctataaaggcatccctgagactggttaatggataaagaaaagtagtttattttggctcatggttctgaaggctgtgcaagcatggcaccaacatctgctgggcttctggtgagggcctcaggaagcttccactcagggcagaaggtgaaggcggggggagccagtgcatcacatggcaagagcgggagcaagagatggggtgggaggtgccaacaagcagacctcctgagaactcagagtgagaactcactcattatcgtgaggacagtaccaagccattcatgagggatccgcccccgtgatccaaacacctcccacctggccccacctccaacattgaggattacatttcaccatgagatttggaggggaccaccatccaaaccacatcaaccctttattgtaagtttcagaactaattggccaagtaaccaaaaatgagcttgggatttttattggacttgcattgaactgagtaagtttcagagaagtgacgtctgtacagtgttaagtctcctcatccatgagcaaactattttcctccattgactcagactctttttatgtccctcagtgaaaggttataaggcttgcaccttcatttctttttatttgttagaatattcaatatttatgttccagaccacagaacacctctacagtaataaaaactgtagtaatgaaaaacacgttttaaagcagttttgggttctatcagggttgggaggggaagagtgctagcttttatttattttctcttgggtaactcttgtatcaatagtatttcatacaaatgtgacactagctgttgccaagcaaagtccttgaggcacatcacgggagacttgtgccccttggttgacatctgttccatcagcatttggttcagcagttgttcaccaaacagtaaatccactaattgcatcatgcatatgctttctttttttttttttttgagacagagtcttgctctgtcacccaggcttgaagtgcagtggcgcgatcttggctcactgcaacctctgcctcccagggtcaagcgattctcctgcctcagcctcctgagtagctgggattacagaagtgcgctgccacacccagctgatttttgtacttttagcagagacggggtttcaccatgttggccacgctgatcttgaacacctgacctcaagtgatccacccacctcagcctcccaaagtgctgggattacaggtgtgagccactgcacctggccacatatgcatctttacccacaggaggattgtagataattttgccaaatgtgtttcttaaatttagaattactttatctgtggaatattattttcctaatgaatcattcttgtttctgaagatcccttgccgtatgctatcaatagtctgtgtcctggttttcaatctaacattatggaaatcttctcctccaacacacttatttgcctgtatctagtcttctcacatttcttccatgccacatgacttctcataatttgcttaagtgacagtaggttcaacctctgattttccaatatagtgtttgatcacatcagcatttatgttaaaatctcaatccattactgctcatgaaaaaatacttgtttttaatactatgaacccgtattcagacccacttaaaaaccagcactcacaatttcgttgggagactcctgtcctgacatatatgattatttgaaaattatagtaaacaggccaggcgtgatggctcatgcctgtaatcccagtactttgggaggccgaggtggacagtttgcttgagcccaggagttcaagaccaacctgggcaacgtggtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttgtccgctgagattgaaggctccatcatcttctacctctagccactgacaaaggcaagtaggcaaacagctgggaaggtggctgtgatctgacagcatgcatcaccatctagtccagtgacagtcatgatcaatcaactccactacaggaggctcagccaccttcaccaaaaggaccgtatgcctcgagtgtccctcctactttggtgtagtcggatagatagcagtcagaacactttaagagcctgctggctaaagaacttcatgatgggtagcgttgaccttttctttaaaaaaaatctccaactccttattcttttttgtaaacccatttgaaattttgttaaatgctgccgttgccagccagggtatttgttctcctaggtttggtaaaatagtcagcaactcaggaagttctaaattcttagaattttccctgtatgttcttggcttatcctttacaaaaaggattcccaagcactgctctgtgcacaggcattgtggtgaaattttcattcatgtgcaatgaaccaagtaaaataaggtcattctcataaggttggtttgtttttttttccgtgagtttttaataatgatatttaagactatcatttattctaatattaagtcttttctcctttcagtgttaaaatggtatttcttttatgaagtaatctggtgagagtatatggcatattggttggtttttttctttttaatatgcctactgacaaaatttttacattagcaaacctgtattagttcatagaaattacttcaatatttaaccatgtctgaaatttaaaattctggcaccatttctgaaagacagttgtgattgtcactcagcaaaattcttatcggtatagaagagtggagatttcaaaaagaaaatggccccaagtccaagtcctccctgagttgataagactctaagatcttccaaatagttttaggctaagtcttatgaaaatttaactaaagatttcattccctttatctctatcaaggaaatattccttaaaagtgatgtcaaccgggcacggtgctcacacctgtaatcccagcactttgtggggtcaaggcagaggatcagttgaagccaggagtttgagaccactctgggcaacatagcaaaacctccatctctatttttattttttttttaaagttagtgtcaagtatgtggttgcaatgaattagcaaagcctctaaaggaacactgtgtgccatttaatcagaaccaggctttgaggacactgtgctttttgtgagacaccacatgtgacttcctgctctttcacctttggaactctgggtcagacatagactttggtccttaaaaacaagaagcttaaatagtgacctcatcttagttcttataatgtaattgcagatcaaatagccatgattcataaaccaacacaaaggaaccctttgcttcctgactgactccagaatgagtgaacaacatgagtaagagcctcgtcgcagagcctttctccagactaccttgctgggtcccggatattaatagtcttggaaagtggtttctacagctgctgctttgcctgaaaatagccatgctttccccaaacatgcacataacactgccttctcttaaagagagcctccaaaataaacaatagtcacccttgacctgctaaacagtcatcacatggagatgagtttttatcctcaccttcttgcttcttcagtgaacaagtagtaacaagcagctcctgcgtgtgcctcgatctgagccggcataccattgctgccgagactgtataaagtgcaaattgaaaagcacaggagactaacatctgtatcagtgaacacattttctttcctttctcacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacggtgagtgagtcacattttccaaaaaccctccccattctgcattgctgtggtgcctcaaatcgttatgctccgcccgctctttaaaaatcatggattagggaaaattgggagtaattaatagtacagtattcgctatttttctaaacactgtgtctcacctacttttgccattgtggtttggatttttctttttttagatcatgtgttcagggtccttagagtcataatactaatttccttcctaaggtgagtaagaacataacttgggagaattcagtctgttatttaaatggtagaatggcttaagacagtggttgtcaacctttatcacacatagcacccaaaatgatgtcatcacggtggggttgactgctcacaccagacaggatctgcccagtcaccccaagggctggggaaagcagtcctcaccctctctcacttccccagcacgtcaggtgggaagctctggcttaggaaattactgaatcataggagttctcatttttgatgttgttgtgatgggatcatgttgctattggatgattattctgttattttgtgttatctatgggggtaaaggagatgggcagataaataaaagcttatcaaagtgcttaaaatccatgaagatgggcttcatttggtacagctacacagtgatagccttccgttggtaccgtcagtggcctaaatttgacttcttgtctttgggagtgctcctaaatttggtttagaacaaaaaagaattcttacaacctagcagatcccatggcaagcaaagaaaaaaatattctaacccatcattatcgtcatcattagtgcaaagtgatctgagcttaaacagcatacattatcataattttttataataaaccatgttgctttattgtgcaaacaagcaatagatagataaaaagtgcagattcttgccttgatatttacatacttcatctaatattggacacaatgttttttcaatcagcattttttgaattcttcctgcatgtgaggcacagagattttaggatgagcaggtgtgagacgcatgggtttgaatagcacagaggtatctggagagcactgtgttggtattctgaatgccctcagagcccagggggataacagctcattatgcctggggtagaacttacccaggatgtggaagaagaggggattcttcaaaaagagctcagcctctgaactggcaaaacagtgagttttgactcaaaggcaccaaagtactaatacatgacatcctctcctggggtgatccgatgtggctggagttggatgagggggggtggctggggatgggaatgggaatgggattgggatagcaggacagggtcacatggccaaggatcttgaagaccatctcatggaacttgaatctgatctctacacactggggagccacggtagggtgggttttttgtttgtttgtttcttggttttttgtttttttggttttaaataaggaggagaagaatgtggtctgatgtgtattttagaaaaatagctctggcagcaatatggagaatgtttagtgaaaagagaaccaggcccagagaggtgggttaattcagctcgggccagaggcaatcaaggtccgcactttggccacagaagtagatacagagagtgggggtgaattgcagacatactctaaaagtatcctcctaccgtgggggccgggggaagggaccgttctagcttggtgactctggctagtgatgccatcggtcatggaaaggacacgggagaaggcagattggcagagccagaaatgagcctggcttgaacagagagagctcagagggttaataggatctaaggaatagtctgtgtctccactggaaatacagacacagtgcttcaaagaaagaggcaggaaggtcaccctggtgggtttaaggatatgggtgaaggcagtcgttaaacaagagacacagggatagctggaaatcagtgagaagacagtgaaggaagacacccctgaaacacccacgttaatgcagccgactcctagcaggggtgccttccaggaggcgggaaggaaggagcagcggcatggcagagaacgtccagaaaaatcccacagacaccgctcgtagcagtgttggcacagggagaagggcctggatgaaatgggttctgaatgacattttcaggtctacagttcagatcagtggttgccaggagttgggggaggggaagcgtttgactgcagaggggcaggagggaactttttgggataatgcaaataccctatgttttgacgtggtagtgattccatggctatatacattcttccagactcatagacctattcacgtgtgttgcccaggctggactcaaactcctgggctcaagcaatcctcccacctcagcttcccaagtagctgtgactacaggctcatgccactgtgccaggcctgtgtataatttaattatacctcagttaacaaaaatgggtgctgaagagcttgctttatattcgttagaatggcctcagtcagccgggtgcggtggctcacgcctgtaatcccagcactttgggaggccgaggcgggcggatcacaaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagctggtgaaagccttggcttagggataagagggcggctggacagtgcaggcccagagagactggaccatcaggggaggtgaggggtgacggaggtgcccaaacagagcatgaaatggtagagtagctgagaaggttagcctcagtcacgatctgtcctgtcctaccctctgaggactctaaaccccgcagtagttcacccaacaaattcattcactcggccaatgctgcataaggcactcagctcggggctacagggagccccaactttaagaagctttctctgcttcaggtagtttacaggtggtagacgcagatagaagtgaattagtaaagagaatagtttggtgtaaaaattgtgcatttaactgaaaccttaattcactactgagcatttaatagccattaaataaaaaccagggcccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggtgggaaaattctagcaaaatgaatcactcttctgcttagtcacccaatgtgcacttattagggtgctgctgaaatacatattcatctatccactccagaaagatagtccaaactgagacctcaggatcagaaagcctcccattctcctgcagggttcattcatttactcagtgaattattaaatgcctacagcacgcagggccatcagccccacagctatgagaaagattcagtccttccctcacaggccttatgatagactccagtaaataaaaccatacaggcacagaatgcggcgggctttataacaaaggcagaaagcccctcttgttgtgtcctcaagggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctcttttttttttttttttttttttttgagacagagtattgctctgtcgcccaggctggagtgcagtagcatgatctcggctcactgcaacctccgccttccaggttcaagtgatactcctgcctcagcctcccaagtagctgggactacaggtatatgccaccacatctggctcattttttgtatttttcaaagagactggggtctcaccatgttggccaggctggtctcaaactcctgacctcaagtaagccactgcgcccggccatctctcacagtgttttttaaaacaacaatgcattttcataacagttggcctggagaggtgtccgaccaagttggaattcatagtagaatccattggaagttaatttttgatgtatttgactgttttccattgacttcgcattgaggcagtgagagagacttgaagaacttagaatacgcacccttttgtcactggcaaacatgggacatagaggcgtgtcttgacagcaatttgtggcaacactctgggctggaatctaggggttagacagcctggccggttttgtaaattagatagccaggccaccctcagagtcagtttgagggttgagtgggaagcctgaataaaaagagaagttaaacttttaagaaaagggtcaagctttaaaactggaattgggttttcaaatttaatgaggaaaaagaaaccccaaaactggaattgtaattgtggagaaatacaactgataatatttggaatatcatctacaaggaatgaaactatccagaagcatttagatggtagtcagtgccatgtagggcacctctgggggcagggtggctcctggcactgtggagaaagacgactggtgcttccttctcccaatcggaggaaagggatacactgtggaggtcccagcagcttagggcctgccccccatgtggttatctctgtgccgtttccttccctctgtcttcctgtaactccttcactttggcccctctgccctttctgggcagagggtgacaggaggcaccgcatgggtacattctttttttttttttttcttttttttgagacagagtctcactctgtcacctgggctggagtgcagtggcgcaatctcgactcactgcaacctccatctccgggtttcaagcgattctcctgcctcagcctcccgagtagctgggattacaggtggccgccactacgccccgctagttttttgtatttttaatagagatggcatttcactatgttgttcaggctggtctcaaactcctgacctcgtgattcacctgcctcagcctcccaaagtgctgggattacaggagtgagccactgcgcccggccaactacatgcttttttcctcctgtcgggattggcctgggctgtacctatctcatggtggaaacctgcccagggaccaggccctagaagaccagcagtttatttaactgggttggcctttgtccccactccctgtgacccggccctgccacatctttacccaggtgcaccactgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaaggtttactgcagttacttcctttgtgtgtcctcttaccttaccaagtcgcctcacccaccatctactgttaattaaattaccacctcccccacttcccacctccagagtagagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactagggaggctgaggcaggagaatcgcttgaacccaggaggcggaagttgcagtgagttgagatcctgccactgcactccagcctgggagacagagtgagactccatctcaaaaaaaaaaaaaaaaaatgggttcgcatgagccccctccttgggttcaattaagttcctaggatggctcacagaactgagagaaacacttatttacagaggtgttatgatatatattgattttcgtccatggttcctggttcctgaatcccataaaccttcttacagccttttgttataatgttgggggtgtcacgcctcaggggcaggcctctgaccttccctgccctccttgcactgtaatgtttcccccatttctgattgtgagtcttaagaccctcccatgagagggtcccaccctacaccttgtgggaaggaatgtggatgtcatgaagtgtccataaaaacccaagaggacagggttcaaggggattccagatagccagacatgtggagcttcctggaaggcagggcacccaggtcgggcatggaagttctgcacctcttcccccatacctcgccctacacacctcttcatatgtgtcctttgcaatatctttttgttgttgttgtttgtttgagacagagtctcgctctgctgcccaggctggaatacaatggcatgatcttggctccctgctacctccgcctcctgggttcaagcgactctcccacctcagcctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgagccaccgtgcctggcctgtagtatcctttataataaactggaaatgttaagcatgtgtttcctttagttctgttagctgctccagcaaattaatcaaacccaaagaggggagtcctaggaactccaatttgaaaccagttggtcagaagttccagaggcccagacttgcgactggtatggtggggggcactcggccctgtgggatctgacactatctctgggtagacagggtcggaactgaactggaagccaccccacctggtgtctgctgcttggtgtatggggaaaccccatacacatttggtcacagaagtcttctatgttgatgactgttgtggtgcgacagcagaggaaaacacggtttgaggagagcttttcccaacacgcttatgtgtgccagtttattatagaagacacagatgaacaccagatgaagagatgcatagggcatggtctgtggagttggggttcacctccctcctggcacaaggatgccttcaccaacccagaaactcatcaagtcttgttcaaggatttttgtagagcttaatctccactccccgccctccacccttcctggaggttgatgggtggggctgaaagttccagccctccaatcttctacttacttggtctttccatcctgaggctagctggaggcccaccccgtcactccattaccttaagctcaggtgttattgaaggagctccttatgaatagagcaaaatcacccctatcagaaatttcaagagttttaggaaacctgtgactggaaccaaggacaaagatgaaatatattttgtatgatagcacacccaccagattggatcgtggggccatatggcctttagtgtggaagctgcttgaccacattttccgcccatgcactgccattctcatttcaggctgcgtcatcatcatcatcaccatcacctgttcttagcaaaggtcgcacaccttccaaatgctttgtatagattagctcatcactccccatactcaccctgggagcatagtcagggataagaggtagagttctagcgctctgtggctactatggtttatgggatctttgcgcaggaataactggactttaaacatcttggcttttcttttcagtaggtcagtcggcatgtactcacagggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcattgcacagatagctgtacagttttttattatttatgataacggtaactgactttttgttaaagctggtttggaatctggaggttattttaattttgataactttatgattttaacttttaattttaactttatgatgtttgtcataaaagagtggaatgtgctcctattttgagatggaaacatttcggcagggagagagaagagagacaccaaaccacctaacagccaggttccaaggggagattcattcagcgtctttgaagcattgttagttttcatttgaggcataaattggaaacttatatctttctttggagtaggaagtatttcagacagaaaaaaaatgattgctacaacaacatcacgaaaaagaacagaaggtttcatgaagagtaataaagttaagtttatgaattagagcttcagatgggaaatcttatttggacagtaaatggttaatggtacagggacaccatgatgggggatctttgcagcattgaaaaaacacgcgtccataaatccttctctagcacttctttgtgatcacagagtcaagctgaggacaatgatggagtgctccagttcatccgaagtgcacgagtcccctttgcagcagactctgacattcccggcccctctccggagtgttatcaacatgcagtcagtgctctctacgtcattactttaaaaacaaaaactcggccagcagcagttcagtacatcttcaaagatcttgacttgtaattttttcccctgcatcttctctattgagcacatgaactgacatctttctacccccaaataatcagttctttccccctaaataaaatgggtaatccaaaaaagacccatcaaaaggaagctaaagatagtaatgcctaggtagtttcgggaccagaatgattgtctctaaatatgtacatgtacagtgattacgtgtttaaaatgtttaatgacttggagaaatagtgtgttgagtggagaaaaatgagatttagtagagcataacgtcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctattgtgccttgtggagattttcctacagcttttctggctgacccgtcacttgcactctggaactctcctaaaccagatacggcccaccacgtggcatggtgtggatcctggactttctgtcatccgttaggttcatattcttgaagcaagtctagaactattttctgagagattccctggctgttgttctgtgtttgggtgggttagtcacctttttaggtgagagacttgatttgggtacacagtttcacaaaagtattgtcaaccctgctggccaagtgactgacgtgctgggcatgggagcacactccatcggcatggcagagtggattcactccatgccattgccagagaataggactttgaaccacagccacccggctttttctgaaaggcctgcttgggcaatgatgcctggagaattatctgaagaatgcagtctgtccattcctctggagatggtctagtttttatccccagaccaagctgaacctcttagagctgtgcatttatattgtgtggaattgccttcagcgacgtgttctataacgtcgtgttcttgtcaccttttgagggacactggtgctgtggggaagatcctcaccaatacgcaacagcagggccctgttctctcacctgccatcccctctggaaagctcacagagagggtttcctgggttgctccttttccaagcaggacttctactgtagacttacagctccagttacaagcctgtgtgcttgtctgtttccccacaaggtgttctgacctgggagggaagggacggaatcctattcatctctgaatcctaaatgccaggcctagcacttggcacacagtgggttccagttgtggaatgaatttttttcagtcctgacaataaatgttggggttctttagtttgtttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagagtgagaccctgtcttaaaaaaacaaaaagacccatgagacctagactccccctgtcaaaaatactcacacacacacatatacgataagatagtatttctaccttttctttctcaaaacattccacagaacagtcttaccttcgaggagagccgtatgcatgaccttttgtttgtttgtttgagacggagtctggctctgtggcccaggctggagtgcagtggtgccatctcggctcactgcaacctccgcctcccaggctcaagtgattttcctgcctcagcctcccaagtagctgggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggttccagactcaagcccttcctctaatgtagggcgggtacaagagagacttgagcaaggatattgggatttaagggaagggcagtgcaggccaaggtcagcaagaggacatctctaagatgaacagcactgcatttgtgggaagcaaccctgccataaacaactcagttaacgtttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattgaggagtgctgggtactaggccattagaagaacaaacaacaacaacataggcctggaccttgcacttgcagagttcacaggctagagaggcacacaagttaaatatagagacagctgaaagagctgacgtctgggacagagggagccccctgctccaggagccagggagcagatgccatggggggctggcagggatagggaagtcaggccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaagaacctagaaacaattttaggcggaagatagttgtgttgggagcccctaagaccatgatttattacagcacaaggatacaaagcaaaattagcaaaaggaaacagcacgtggggtcaagtccaggggagctcaggcgcaagcttccagagtactctccccatagagtcacacaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagcttgcagtgagccaagatcgcgccactgcactccagcctggagaacagagactccatctcaaaaaaaaagaccttttgctcctctttgctcttgtgtctgtttaacagatttttatgttaacaggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatatttgaaaatatacctttaaaatcaaagacatgaatttgtgttttgggtttttttttttcagatttgaataaagcagagtataatattatagttgctgcaggaagttatgagcatttctggaagtgcttattttcagcacatgctacttagaattttaaaggacattcagtgtatctttgtcatgaatctttctactgggaccaggccactcctggatgaactcacagattgagagcttctcaaaatgtaaaatcaaattgtcttttaaaatatgctattttaaagttctggagaatcaatgaactttaaatgaaaatcggccaatacttggcaaaaagtcaatttgaagagttgtctctttataatctctgatttcacttatagagcttgcttccaaaaaaagtactacgtatgtcataaatctgaaatgttttgcttttatgccatttttaagtcctgataaatattcttgaagtgttaaattattattattattattatttgagatggagtcactctgtcgcccaggctggagtacagtggtgtgatcttggctcattgcaacctccgcccccccggattcgagtgattctcctgcctcagcctcccgagtatctgggattacaggtgcctgccactgcatccggctaatgttttgtatttttagtagagacagggttttaccatcttggccaggctgttcttgaactcctgaccttgtgatccgcctgcctcggcctcccaaagtgctggaattataggcatgagccgccgtgcccagccagtgttaaattatttttaacttgttagaaataattgtcccacaacttactgaaggttggtttaatattcactattgttcccaaaaaactcttaaaatattaaaccaactcatagctcataacttttcaaggtagcaagtgtttgctaatcttaaaatgtgttactattctttttttgttttttttttgtttttttgtttttttgttttgagatggagtctccctctgtcacccaggctggagtgcagtggtgtgatcttggatcactgcaacctccacctcctgggttcaagtgattctcctgcctcagcctccccaagtagctgggattacaggcgtgccactacgcccagctaatttgcttgtatttttagtagagatgaggtttcaccatgttggccagactggtctcgaacccttgacctcaggtgatccacccgccttggactcccaaagtgctgggattacaggtgtgagccaccatgcccggccactattcttaagtgaccttctgcacatctctgtagttttatgcctggtgatggcgtttaatttaggagtatctggcatgccactccagtctgacagctaggggcatgttagcaaagggggcatttttcaggtgagtgggtgagcatagccgtgctgaccatctttcctatccagagggaaggcctagcagggactcacgccatcttgacttgcctgccccaggctccctctcactgctcccctggcctcttcctcttctccagacaatggggccttatgctcgctgtgtttgtcagaactctcttgtggttgtggctgcaagtaagagaaactcaactcgagcttattcagaaagaggggatggattgacccagataacagaaaagtgctaggctagatctggccttagccacagctggatccagccttctggcatttgtgctccgttcctcagccctgccccactgggagtgatgccttctgttcacagtgtgatctgcttcatactcaaaactccctatccagaggaagaggaatcttttctctcccaccatctgcacagcagtattcaggaatcccctgccaggctctgttggcctcatgtgccctgtcctaatccaccactgtgcccagccagggtgtggccatacatgcccatcctgtgcatagggcaggagcagacccacctgcaccacatgcggtggccgccatgaccacaagaccaggataggagtgctgatcaggccagaccccaagggctgttgctcagaccatacctggcctgtagagtagaagaactaaatgtctcacacaggcaaagactactcttcaattcctttaattgcaggtgtatgttggagtccatgaaatacaaagttattgagaagcataactaaatttatagtagctcctcattatatattttcatgttgataggattctgcccccatgggaattaattttcttcatcaaaagtgatctccatactcacaaacactgaatagctttgggcttttaaaaacaatgttttggctttaaaagaaccacaggaggctgggcgcggtggcttacgcctgtaatcccagcactttgggaggccgaggcgggcggatcatgaggtcagaagattgagaccatcctagctaacatggtgaaaccctgtctctactaaaaatacaaaaaaatcagcctggcgtggtggcaggcacctgtagtcccagctattcaggaggctgaggcaggggaatggtgtgaacccaggaggcagagcttgcaagtgagctgagatcatgccactgcactccagcctgggcgacagagcaagactccatctcaaaaaaaaaaaaaaaaaaaaaaagaaccatggcaaaagtgtcctttagccgggtgcggtggctcacacctgtaatcccagcactttgggaggccgaggcgggtggatcacgaggtcaggagattgagaccatcctggctgatacagtgaaaccccgtctctactaaacatacaaaaaattagccaggcgtggtggcaggcgcctgttgtcccagctactcaggaggctgaggcaggagaatggcgtgaacccgggaggcggagcttgcagtgagccaagattgcgccattgcattccagcctgggcaatagagcaaaactccgtctcaaaaaaaaaaaaaaaagtgtcctttagtctactgttggttcttccaaagagccatcctttcgctgatgctttaggaactcccaacctgggtcctgtcaaggataagctctcatcttattcccacaaaattcctagagttactcatcattttcctttcatattcagctcattaaagcagtttgtaggtctctgtagtccatattagtaagtgttaaaaatgtatcaatttgattttttttttttttttgagacagagtcttgctctgtagcccaggctggagtgcagtgttgcaatcatggctcactgcaacctctgcctcctgggtttaagggattctcctgcctcagcctcctgagtagctgggattataggcgtgcaccaccacgcctggctaatttttgcatttttagtagaaacggggtttcaccacgttggtcaggctggtcttgaactcctgacctcatgagccaccgctcccggccatcgatttgattattataaaatcaggttatattggtttgaccagttaaaaacatcacaggttatttaatctttttatttatttatttatttattgagacagagtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagtactttttcaggctcttaatgtttccatccactaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtgtttctgtagttagcatcaggtgtccttggttctgtttaccagcctgtccagggatcacttccctggtgggatctctctggtgaccctcatctcagagctcagcggtgcctttggggctacttgccagacaactccatgtgacagagggccaggtccaagtgctcgatcaccccagccaccatttcagagttctcggattatagatccctcaacgagtcccagtgagacaccgaacatgccatagaagctatgtttttctatttcagcacacagtaaaacactacctcttagatgtcgatgagtacatgctgcttttatgttgacgcagaggacctgtgttgactcttcatcggcaaggtgtcttttttttaagtttcaattgacacataccacctctggcccaagtggaccacacagttatgcatgccctttggtgcaagatacatcacgtctccaagaactcgggtgtttttctgatcatggagaattagattccacatatagcttgtatttaggatctgcagattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaattgatacaatggttgtgttgggtgatggagatagaaagagggagaagaagtgaaagtgaaattttggtcaaaattggataccaccctaataagccgggagataaggggtgctgcagaactgttttctgtgatacagtgcatctacattgataatttgtgttttatgtacttttaaaatgaggctttattggcttgatttctgtgagaaaaatcactaatgggctgatcgtactgctctacttcaacatgcaagagaattgctcagacgcttgtcagatgcctgaaccacatacttatttgagaatgtgccatcataggaagctttcattcaccaaggtcaccgagagggcagcccagggaagcacgttgaacttcgcatggttctggccactcgtgtcagtagcaaagcaaggaaataaggagctgacttgcccaaaaattacaagttcagagaaaacggacttgttttgtttggaaaaggcagataacggagcagtaactaaagaatcctctttttttattattattgttgttgctcaatttataaacctaaacagaaaatgtgtgttgccttatttcctcttcttttctacagataactttcttttaaaacattctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgatacataatgttatgttaaaagcacactgcattctagagaaggtagagtaacagggtcttactttaccctcccacttgaaacaagtaaaaaactggacaaagtatatgaaaaatacatcactcagggcattggacaccaggcagcaaaaaacagtggcccctgagaaattggaaacaaagtgagtcctataattgtccttatctagaaaaagtttcctggctactgtgtagagagaaggaacccaggagaaagagctcaactgtctccctgagttgaagacagagctggggatacatcaagggaaaccaaggcagctagtttgcagaggtggaggaccggagaggagagaactgcatagagagagctttgcggatgtacagagtcctccttgagcatgcaagtgcgtactgatcaaagtgtggttgtgagaaaactacccatcaccagagaaaggatcacccgaaagaatgagggaacagtgcctgcctcccacacagtagccaagaagaggtgcctgttgccaacagctagagtgaaaacctctgaatgcaggggcactggttagaatactaagaagggtcttgccagacatccaatccaaaattagcaggcatgcaaagatctaggaaaataccacctaaaatgagaaaagtcaatcaaaactaacccattatacagatgatagaattcatagacacggacattaaagtagttgttgtgactgtagtttgcatgtttaagaaactagaagaaggatttaacatgttaaatagagacaaagaagatataacaaagatataaatcaaactgaagagatgaaaactgcagtgcctgaaatgataaaaaaaaaaaactcttaattaatagcagattagacattgcaaaagaaaagcctagttaacttaaagacatgcagtagaaactatctgaaatgaaacagaaaaaggctgaaaagaagcaagagagcaacattgagctttgggatcattttaagtagccaaaaatatgtaaaactagagtcccacaggagtggaaaaaaggaactgaaaaatatttgaagaaataatgggcaaaacgttttcaaatttgatagaaactataaactcatacattcaaaaaaatgagaacattttaaaaagagaggataaatgacacattatgtagagaggaacaaagataaattggctgatgatttcttgttggaaacaacacaaactagaaggtggtaggtcaatatttttaaagcagtgaaagaaaattcacagcctagagttttttacctggttaaaatatctttccaaaacaaagctgaaataaagactattttagacacgtaaaagctgaaaaaattcatcactagctaacctgaagtacaaaaagtgttacagaaattcctgctggcagaaagaaaatgataccagttggaaacctgaatctacccaaaggaatgaagaacaccaaaaatagtaaccgcatggatagaaagacttgttcttactgtttatcttaaaagctattactgtatacagtaattactgcataaagcaaaaataataaaaatgtagtatagcgttaaaaacatttagaagctaaatatatggcaacaataacacaaagtctaagaggagagaaatagaagcatgcttttgtaaaattcttaggctatatgtgaagtagtataactatatgtggtgtggtagtataattatatgtgaaggtagactgtgcaaagtgaaatgtgtatgtagtcatgtgctgtataataacgttttggtcaaaaacaaaccgtgtatacaacagcagttccatcagattataatactgtattttttactgtaccctttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaagggctcaaatcatacaaaatatgttctctaaccacagtgggattaaattagaaatcaacactgaaagacatctggaaacactccaaatatttggaaataagctacagagtgggagaaaatatttgcaagttatctatttgatataaggatttgtatatggaatactaaaactcaaaactcaatgagaaaataacgcttttaaaagatgactgaaagatttgaacacatatttcacccaagaaaatacatgaaaatatgcttaccatcacaggcattagggaaatggaaatttaaaccacagtgaataccgctgcatagctattagaatgtctacaattaaaaagattgaccagctaagcacagtagctcatgcctgtaatcccaacactttgacaggcagaggcaggaggatggcttgagcccagcctggacaacatagggaggagactctgtgtctacaataaaagaaaaagaaaattagccagttgtggtggcctagctgctcacttgggaggatgaggtgggaggattgcttgagcccaggttgaggctgtagtaagctgtgattgcaccactgcactccagcctgcaagacagagcaagaccctgtcccaaagaaaaaaaagattgggctgggcacggtggctcacagctgtaattgcatcactttgggaggctgaggcaggtggatcacttgaggtcaggagttcaagaccagcctgggcaacatggggaaaccccaactctactaaaaatacaaaaaattaattgggcatggtggcacacgcctgtaatcccagctactcgggaggctgaggcccgagaattgcttgaacccaggaaacagaggttgcagtgagccaagattgtaccactgcactccagcctgggtgacagagtgatactctgtctaaaaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaaccataatactggaggctagattacaatagagcaatatcttcaaaattcaaggaaaatggccaggcgcggtggctcacgcttgtaatcccagcactttggaaggccgaggcgggcggagcacgaggtcaggagatccagaccacggtgaaaccctgtctctactaaaaatacaaaaaattagccgggcgtggtggcaggcgcctgtagccccagctactccggagaggctgaggcaggagaatggcatgaacccaggaggtggagcttgcagtgagccaagatcgcgccactgcactccagcctgggcgacagagcaagactctgtctcaaaaaaaaaaaaaaaaaaaaaatcaaggaaaataatatacccagctaaaccatcatgaagtgtgataagaataatgacgaagccagacattttagaaaaatctacccctagcgccctttttctcaagaagccactagaggagtatttcactcaaatgagcaagcagaggaaggaggattgcttgagcccagcctgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcacacatttagtggcttaaaacagctcacatgtattatcttccatttctctgggtcagcttagctgggttctctgcttcagactgcgaaaattgtctcatctgaggcctgggttcctcatcaaagctcatttggcagaattccattccttgaagttgtgggactgagggcccagctttttgctggctgtcagctggaggccacacccaggtcccagaggccatgtgggtttttgccatgagaccttctccttcgtccattcacagcatggcagcttatttcttgaaagccagcaggggggatgggttttctctggaatctgttagatgaagtgacctcccttcactgtcactcgtgccatattctgctggtgagaagcaagtcacaggcctcacctgcactcagggagggactcactgggagtcgccgccacagtgtggctccaggaatggaaactaccacactgcagaggtgcagggaatccccaggattatggtcaagaaagagcccactaagtgttttgttcagtaggcctgcaggatgaagggtgccaggaggatggctccatgaaagactgagcctatacgtgaacgtactgaaagctgacttacagttcagccagtgtggtggtatgtgattgacagcgccctagcaagatgagcaacaaagatacaagactccagcagaaacaagctgcagaagaacaggagtgtaatcaataaatcagatggccttgctgtgaacggttacatagctctgataaatcctgatctaaccaaaagtcatgacagctcgatatttgggagctggagggggtggggagtaggggtagtaggatatgaaggagctaagtccccattgttgatattagaaatccagtgggtaacatctgaacggcaagaccaggacagcagcgaaaggcaaaaagacaccactgagtgttgacagtggctgcctttcaggagtgggaatgccactgggggcagggcagtggggggcagggaacaggtttttctgtttgttttttgtttgtttgtttgttttgttttgagatggagtttcactcttgttgcccaggctggagtgcgatggcatgatctcggctcacagctggagtgcgatggcgtgatctcggctcaccgcaacctccgccccccggattcaagcaattctcctgcttcagcctctcaagtagctaggattacaggcatgcaccaccacgcccagctaattttgtatttttagtagagacggagtttcaccatgttggtcacgctggtctcaaactcccgacctcatgtgatctgcccacctcggcctcccaaagtgctgggattacaggtgtgagccacttcgcctggccatgggaacagtcatgttgcatagtaagccctaaagagcagtgtgatctcttaagccagcacgtgatttactttggtaaaaattaaattaaaaaaaaagaaattaggccaggcgtggtggctcacacctgtaatcccaggactttggagagccgaggtaggcggttcacctaaggtcaggagttcaagaccagcctggccaacgtggtgaaaccccgtctctacttaaaatacaaaaaaaatagctgggcgtggtagtgcacatccataaatcccagccactcgggaggctgaggcaggagaattgcttgaacctgggaggtggagatttcagtgagccgagattgcgccattgcactccagcctggatgacggagtgagactctggcccaaaaaagaaaaaaataatcctattggtctcatagtgtttctctgtatttttaatatactgtgtatgtgcttatgagaaaccgaaagagaagtgatttgtgaacgatttgaggacttttggtccacgtttttttctcccacttatacttgtggcataatccagaggaagaagggcagctgcggagtcccagcagtgttgcgggtatcagggcagccagtgagaggatggaggagaaacccaggagagggcagaggaggagggacagctgtgcccacctggtcctttcattgttgtctgcctctgcccttgcagttagaaaaagagtgttctgtgtatagaagcctttgcaagtagcatagttaggagtctttcggtccaggaattgaaggtgctaaagcaggaggaaaacatacatagaagaaaggaaatgtccacataagtaagtgtattagtctgctagggctgccgtaacaaaagaccatagactgggtggcttcaacaacagaagtttattttattttctcacagttctggaggcgggaagtccaagatcagggtgctggcagggctggtttctgctgaggcctctcttcttggcttgcagacagctgtcttccctgtatgtcgtcttctctgtacacaaacatccctgtgacctcttcctcttcttttaaggacactcagtcctattggattagggccccatgcttatgacctttttgggttgttttttgtgtttgttttgagatggggtcttgctctgtcacccaggatggagtgcagtggcacgatcatggctccctacagcctcgacttcctgtctccaaatgtagtcgtattgggggattaggatgtcaatataggggttttgaggggatgcagttcagtccattatatacagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgcaaaaaaaaaaaaaaaaaaaaaaaaatagccaggcatggtggcacacgccagtaatcccagctacttgggaggctgaggcaggagaattacttgaacctgggaggcagaggttgcagtgagctgagatcttgccactgcaccccagcctgggtgacagagactgtctcaaaaataataatgatttccctgtcttatgtttttctactacacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgagtttccaaacaataaaatatattattaaattgatttgttttccacacgtagtggagattttcatggtgtgctacctgtcggtcaaacggctgatgaatgagtatgtcgcaaaaactctaggtgggaatatgacacatgaggaatggaatttgtgcttcagctcttcccagcatcttcttgggctgcacaagagttggtagtctttcatctcctaaggactgaagggccatttagaatcacacctgttttgagtttatagtcacgcttctgaaactttctctcttacagccttatctgacctcaatcaagctacccctgttcatttaaatactttaggtcttggctattggtttagcttaacatttgattgccataaataagaactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcacaatcaaaaaaaacaaaacaaaagaagtgaaggctgagcgaagtaactcacccagcaagatgcaattcgtatagggtagagtcccctgtctcccgataatgctttgccccacacctgaaagtcttgatctggttcccattacccctcagactttgggtccccagtagaacctttgcacttgcagttctccttcctaatgggctcagggaaactcacatgactgcctggaggctgtttctgcacctgtagatgggaatgggcaagtctctcccgactcacttgtctcatagtgttgttgaaaggctcaggtgtgatcattacagtgaaataaggaaaggcagggaagaatctccatcgttctccaaatacgaagaatgaaatgcaatttttttttttttctttttgagacgaagtctcactcttgtcacccaggctggagtgcagtggtgccatctcggctcactgcaacctctgcctcccaggttcaagcgattctcctgcctcaacctcccgagtagctgagattacaggcacctgccaccatgcccagctaatttgtgtatttttagtagagatggagtttcaccatgttggccaggatggtctcgatttcttgacctcgtgatctgcccacctcggcctctcaaagtgctgggattacaggcgtgagccacagcgcccggccacaaataagtttatacccttgtagtcatggcctttcttttatctttctggtaatgaataaaaatgaagcatataagtgacagagaaaccagctacttgatcaatagtggcattgtttcacaattgtctgtattggattttgccaacccactagagagttaccaaagcacatttctgacataactatgattgatttttttttaatttttgactaaatatgttactttgactaaattggttacttcattgcataatggtgaccatttacacttttcagataggtacaaaaaatctgtgtattctagctggccatgaaagagtagcaagcctgttatttttaagaaaaaagctcgagtagttactgtatttgtatcattttggaaatctctcatttttctaatcagcaaaatggggataatgtaaataacaataaccctgacctcacagggttcttgggattaaatgagatatggtgcatacaacgtgcttagcatggcgcctggagtatggtcagaacttaacaaacacaagttataaatgaggtcccgaaatacaagaaattcacttcctcagaaaccttccttgagcctggctacatctatagctacattttctacatgttaaatgcctccctcagaagtgtcactgttggagttgccagggcaccaatttattactttgaaaatagataaataaaagaatcaagacaaaagaaaaaggtgctaccaaagaagacattctgtcttacactggatcacacgagatgtggatatttggcccggaactgctcacatgggtcagcaagcctgagaatgaccgtggagagaaatggctggggctgcaggactcagccaagcctggcacgcgtgtcttccgggcaccggagcaggacgttgtctgaaaacatgaagaatgaaatggaagtaatgtaatacctggggtcggggctgggggaagctttctaagtacaggcagggtctttctatgttgcccagggtggtcttgaactcctggccccaagcgatcctcccacctcggcttcccaaagtgtggggattgcgagtgtgggccactgtgcctggcctaattactgattttaaatattaatctttctaaaagtcaaactccagaactgtgcatgtagaactattcaatttctgtatataactatagaaatatatattagacgggccgggcgtggtggctcatgcctgtaatcccagcactttgggaggccgaggcgggcagatcacgaggtcaggagatcgagaccatcctggctaacacacggtgaaaccccgtctctactaaaaatacaaaaaattagccaggcgtggtggcgggtgcctgtagtcccagctactcgggaggctgaggcaggagaatcgcttgaacccgggaggtggagcttgcagtgagccgagatcgcgccactgcactccagcctgggtgacagagtgagactccatctcaaagaaaaaaaaaaaaaaatatatatatatatatatatgtatatatttatatatgtatatacacacacacacacattagataagcacattgtttatataggaatcaaaaattacctgtgagtaatttttatttatgtaatttaataattacataaaaattatttgcagaggttacctctggaagcagtattagaagtggaggacttttttcttctatgttgaaaatattttaagtaaatttttaaaaacgaatagaaatttaatcaggaacaggctttctaccattaaaaaactttatagtcttctttacaaaagaagagaaataattgtacttgttcagtcattcaaggccactgaaataattggcatagcttgagctctgtagtactgtcacaatatgcaaacacagtgtggtaatttttatagtaattgaacatgacttacgtcttagaaagtcataagttaggaatttattctgttcgttcttttgaagtgaaaagtaaagaaagcaaaacattttttggccgggcgcgttgtctcacgcctgtaatcccagcactttgggaagccgaggcgggtggatcacctgaggtcaggagtttgagaccagcctggccaacatggcaaaaccccatctctactaaaaattcaaaaattacctggccatggtggtgggtgcctgtaatcccagctactcgggaggctgaagcaggagaatcacttgaggccaggaggcagaggttgcagtgagcagagattgtgctactacacttcagcctgggcgacagagcgagactctgtctcaaaaaaaaaaacaatgactttgacctgaatgtcccaagggtctgctttgtgtagtctgcccctctacaagcagggaccaggtcttggtcacctggtgtccttgtagtaagctcttagcagggactgggtcctggtcacctgggtgtcctggtagtaagctcttagcagggactgggtcctggtcacctgggtgtccttgtagtaagctcttagcaaaggttgctgagtcgaatgaacttcaccgtttcggtcctttggtacagtaacaggcactcaagagagtccacgctgtagggttgatcagccaccatgagagagaagtatactctaagagcacacaccatcaaccccagagcatccctgccgaccaggaatgtagttacagcggtgcaggttcccagctaccccaaagaaatcccaggagagtccatctctactaagtcaagcaaatagaaattgcaactgtagcagcacaatctattttcattatatagtgtgtgtctctctctcccctcatctctctctctctctcctttcccctcggtcacttgacattgatactgggccatttatcctcgtgcatcatcttagagttacatttgtataattatcaacatggccatttgatataaacaattccgtccctcacatccaaagaaaagggaagagacagaaagaaaaggcctaatttctgagcaatttttgttgtttgtttcccattttgtaattgtcctccatctttactcatctgtttttttaaatattaattatttttttgagacagggtctggctctgttgctcaggctggagtacagtggtgcacatggcttactgtagcctcgacctcctgggctcaagagatcctcccacctcagccccctaagtaactgggaccacaattgtgcaccaccacacctggctaatttttgtttgttttttgtagagatggggctttgccatattgcccaggctggtcttgaactcctgggctcaatccatcctcctacctgagcctctcaaagtgtcaggattacaggcgtgaaccaccatgcctgaccaaaaatactttctgagggtctaatattgccaggcaccgtgttaacaattcagaaaatactcctgcttaataaataaagacttgaatttttttagttacttcattgaaaagaaaatctttttatttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggcgtgcggccagaggtcaactcccaacggctgtctgggctcctttttccctgcagtgctgtatgtctgggggggtgacaatcctttgataacagttttttttattgggagaaaatttgtgggaatgcataaggtcttgctaacataattccacattatgcttgctcaacaggagaagttttagtttaaatgtagacttattggagatggctgtatatctgcaggtcagggagtctcgcgtctgcagattctttgtggtttctcgtctgtcgtcgcttatcccaaataagtagctgcacttcttggaagagatgattgcgtcacttgaaggggtcatgggagtctactgattgaactcatttttctcccatctgaaagaaagaaaagttgaaacaagaggaaagacatttcacactttctggcatttaatatttcggctagtttttgtttgtttgtttcttttttgagacagattctctctctgttgcccaggctggagtgcattggtgcactctcggctcactgcaacctctgcctcccgagttcaaacgattctccttcctcggcctcccaagtagctaaaacgacgggtgctcattaccacacccagctaatttttttttttttttttttgtatttgtagaagagacagagtttcgccatgttggccaggctgacttcaagtgatccgcccgcctcggcctcccaaaatgctgggattacaggcatgagccactgcgcccggcctggccaggtttagatcctggttttgtgaaagaatcagaatgactagaagattcatgttccgatccactgcagctaacaaatacagctccaggaaccgcacaaatcctgcatcgcctttcatcagcagatagttaaaggcggagaattgggttttcttgtttgtaaagatagtgcgtgtaaacaagcatgcagtaaattatgttatctgcagtagagtcttccattggtagctttggtcagacgagctgaaatacactgccttcagggttcttcttggtttgtcaccgtgagtagagatttgaatttacactgcctcatctgtactgaattctgcccttgctgtgaatcatgtcacagtctcagaagcagcagcagccatagagtccagtgacatccttaccagtaagatacctttgacctagagagttcatttcaggggtggggcagcatcagtgtggctaaatgtgaatattcatttctttttcttaaactataaaatgcttgttcttttccaaatccatagctaggcacagattatagaggcatcttaaaaagccttctatagctgggtgcagtggctcacgcctgtaatcccagcactttgggaggctgaggcgggtggatcacttgaggtcaggagtttgagaccagcctagccaacatggtcaaaccctgtctctaccaaaaatacaaaaaattagccgggcatggtggcaggtgcctataatcccagctactcgggaggccgaagcaggagaatcgcttgaacccgggaggtggagattgcagtgagccgagatcgtgccactgcactccagcctgggtgagagtgagactctgtctcaaaaacaaaaacctcctataaatgccataagatgccggcaaatgccatctcaaaatgcagttaggcaggaaaattacctggtatgagttgtaacctaggcaactggaaaaaaatatgtgtccaccagttacccttgtgtttgatgtttcaagtagtagaacagtataagtgtggttttctttctggggtctcccccattgtatgcactcactgtagtaaccagaggaaaatgttaccttcctgctgggaaccttaacttccgaggctgtgatacccatcttcatacctaaagttttaacatatagcaagtccccacctacaagcaggtcttatgtcaaaagtgtagttgcagtttattgcctggaacccggaatggattttcccataggcgtgttatgaacggcagctgtattccaggcagctgtggaagcctttttagcccatttatatacctgaagtgcagtcatgtgcaattagcaagacaagaaccagccatcatccatcacaatgttttatgtgttcccccagcctccccactcccactctcagttggcccagctaggcagggaagggggtgttaatgaggcctgcaggtgcacagatttactccccacctgctgcatctgcaggggttaaaccggcttttccctccccttcgctctcaccattccttctctccctctccccacccccagtctccctttccctgtgctgaaggggctgggcagtgaagtgaggaagggtggctggagctgttgggggctgaggccacattgtgcagttcacatcagaaccccctggggacttgctccagttgcagattcaaatgcagcaggtctggggtgggctctgaaattccgaatatctaacaggctcccaggtaatgcccatgcacaggcccacaggccccatttgagtaacaggagtctctaaacaccatgcagggaggagaggctggtgaagagggaaacctcgagtcacgactgaaaggcagtggagggtgagagctgagttctattctctaggccttagggaggtcccttttacactgagaactttttgccacatgggaagaagcaggcaaaccctggatgccatcaggtgctggcacatcgcagcctcatctcatgcaaggtgttcttggccagggcctgtggaggttctacatgatatggcattaaccctcgggagagcaggcacagtagaacctgaatgtctcctccaagcgactgggtgcagcatcgctccatgtgactgggtgcagcatcgccccatgcgactgggtgcagcattgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtacagcatcgttctatgtgactgggtgcagcatcgccccatgtgactgggtgcagcatcgttccatgcgactgggtgcagcatcgttccatgcgactgggtgcagcattgccccatgtgactgggtgcagcatcgttccatgcgactgggtgcagcattgctccatgtgactgggtgcatattgctccatgggcatggtttgtatgaaacactcactattaaagcacagtaggaaatgctgaaatggaaaaggaatgggtcatccgggagccccaggatctagaccctggagcagtgtttcagggcctgaggatccgtcaagggggccagcatcagaagccccagcacacagggggcttctgatgcaggaggagagtgtgcggtttgaagatctttcatcccaacacagcaaggcggtgaagaaccagttttcatcctgtctccaccactaactagccatgtgtccttgagctcataccctcatgcctaagtgtcctctgtcctcatccgtaaagtaaggctaaaatgagtacctacctcattagggtgctgggaagctcaatgagattatttctgtaaaacccttagactgtccattaagtgtcacaaaagcagtcgtaggggtggctgtggcggtatggtagtggtgaaatgagtaatttgagattataggcctaaagtcaaatttctggttttgcaactttttactagtgtgacctgggcaagtgacttagcctctccaaacctcagtttcttcccttgtaaaatggaaataataaaagttcctacctgctatattattgagaggataaaatgaggaaagcacgtagcacagtgcccatcacaaagcaagctctcagtagatatcagttactgttattgagggagaccggggtgacgactggcatctgaacaggagttttccagctgtgctccaggagctataggttttacaaaaatgtgtcttgggggtgagaaggaggccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcaggtaggctgatgtgcttcaactttttctctctttgtttttttccagttcatatcctttttttgtcattttttttttctgataccacagaagtgatctgataaatcctttccttcctttgttactcaaattcctaccaaatgattttccgtgactggagttcactcctgggtgtggctgtgagttacatgctcagatgctcagtacacaacccttagtgtcctgcgctcgagtccagtgaaagccaagttatgtcatccctgaatatagatgtgtttagagcatctctgaccataacagaactctgtaaactcattgttcttttccaggattaaaaccagcgtctgttataattttaaaagagtaacttcctaccttcctgccacgtatctcttggtacagagctagaatcatgtgaaagaggaatcttggtgtatccgtttcctggggctgccatgacaaagtatcgcaaactgggtggcttaaaacagtggaaagtttgaaacagttctggaggctagaagtccaaagtcaaggtgtcagccaggccatacgccacctcgagactctgggtggaatccttgctggcctcttcctagcatccagtggtggctgtcactccctggcgttcccaccttgcagctgcgtcactcccgtctcagcctctgtggtcccaccacgttctccctgtgtctgtgtcttcacatgatgttcacctcttataaggaccccagtcctattggattagggcccaccctaagaacctccttttaacttgattactctgcaaagaccctccttccaaataagatcactctcagccaagcactttgggaggccgaggtgggtggatcacgaagtcaggagttcaagaccagcctggccaagatggtgaaaccccgtctctactaaaaatacgaaaattagctgggcgtgttggtgggcacctgtaatcccagctactcgggaggctgaggcagagaattgcttgaacccgggaggcggaggttgcagtgagctgagattgcgccactgcactccagcctgggcgacagagcaagactctccttctaaaaaaaaaaaaatcactctcacaggtgctcagggttaggacttaagcatatcttttaggggacacagttcaacccagaacactcaactgtgtggcacaacaggtgtgttcggctctcttgtccctggacagacacatagccatgggacagaccatttaactagagggccccatgggttccaggaagggcagggcagcagaaagtaggccacttgatgacttcgggtttgcacagtctcaggttgggctttgactctgagctgtcttaggcagcccagacctggggactctcggtcttattcatgtccacgccacagcactgcagccatacctgctggcttctatcctgactccccatcgtgaagaaaaatgaccacattcctaaacctcttccctgggagacaactcctaatcagaagcttgaaaggctcagggctgcttctcctaccccagggatcaaacatgtcctcaccatattctaaagacacattctttccccgcaagcaccccgcctccttctccccactgactcctgttcctgagcccagaacctctccctcttgccagcatattctcggcctttgcagatgagcttttgtggcctaaagaccttcttcttcaaccatctctgagttacggctccaagccaggcacccaggattctcatttcatttgtttcactaccaggagtccacttgaggacttgttgttgttgttgttgtttgagacagagtctcgcgctatcacctaggctggagttcagtggcgtgatctctgctcactgcaacctccgcctcccgggttcaagcaattctcttgcctcaccctcccaagtagctgggattacaggtgtgtgccaccacgccccgctgatttttgtattttatttatgtatttatttatttgcgacagagtcttactctgttgccaaggctggagtgcagcggcactgtgtgggctcactacaacctctgtctcctgggttcaagcaattctcctgcctcagcctcccaagcagttgggattacaggcgtccaccaccatgcccagctagtttttttatttttagtagagacagggtttcaccatgttggccaggctggtctcgaactcctgacctcaggtgatccacccgcctcagcctcccaaagtgctgagattacaggcgggagccaccacgcccagcctaatttttgtattttaatagagatggggttttaccgtgttggccaggctggtctcaaactcctgacctcaagtgagccacctcgtctggccaagtttttttgttgaggctttgttgctaaaacactaaagacctaggctatggtgagaaagataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaacaaagaaacccataaactcaagtgttgataaaatgttgtttcatcttttggtgtgagcttgtgtgttgccaatgtcttccattccccagtaaggctgtggggaaataattgctatttccccaattgctagttggcctagcaattctctttttatgtcaggaacccattatgttacatttctgccatttgtcatttttctccagaataagtgtgtttgattctcccatctctcttggacagtatttttccagcttttggtgagttttcacatgctctccaagtaggtcatataagtccaattataccttaatcactgtagttaggactcaggtcctactcagggatacatccttagcattattaatgcatacccttaaatcctttattacctactccctaacaagaattcctccagatcttatatacggggcctgcagggcaggacacaggcctatggtaattacttccaatgtatcgggcattgtgctaagcactttgcatgggtggtcacagcacctctggagccaagtgttgtcccataagggccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttatcatatttctgagctttggcaagattcattcaaatgaacacacaataaagtctggcaaatttcctgaagaattcaaggactcccttacttctttattgtactgtgcaaagttacgttgagtacggaatcagattcactccagtcctgctacaaatgtttgttatttacaaaagaattgctttttcttgaattacatacacagaaataagttcaggaaagaaattagtttctttcctaaactggctttagggcatctacagacaaatggttaaagaaaatgtggtatgtatagagagtggaatactacttagccattaaaaaagaatgaaataatgtcatttacagcagcatggatggaagtggaagttattatgtgaaataagctgggcacggaaagactaatgctgcatgttctcactctcatgtggaagctaaaaagcttaccctcatagacagaataaatggtagataccagaggctgggaaggatgggtggctgggaggaggttatgaagaaaggttggttatgggtacaaacatacagttagacgaagaaataagctctaatgtttgatagcaaactaggatgactatactcagcaacaatattttgtatacttcaaagtaacaggaagagagtggggtgtacttgaaatgataccaacatacagtagtaatgataaatactcaagataatggacaccccaggtaccctgacttgatcactacacattccaggcacataataaacactcatatataccccataagaatataaaatattaggccaggtgtggtggctcatgcttctaatctcagcagtttgggagtccgagtgggtggatcacttgagcccaggaattcgagaccagcctgggaaacatggcaaaaccctgtccctactaaaaatagaaaaattagccaggcgtcatggcacgcacctgtaatctcagctactcaggaggctgaggcaggcaaatctcttgaacccaggaggtggaggctgcagtgagctgagatcatgccactgcactctagcctgggtgacagagcaagactcggtctcaaaaatatatataatgtatcaatacaagggaaaaatgggcagaaattttcaatgatatttaataaccataaattaatcttgagttgggttgctgcctgccagcccttctgtgaacatgatttgttcagtcccaagtcacaaaccacagggttacaaagtaccctgggagggtgcctgagctctgtggttttagtcttgaaactttatcttttcacaaagcaattcaaaaattgctcatcaccattgtgttccgagaaaaggggcgccaaggcatcaccctgagccatccgaggagtgctgtgtgccttcttcctttctgcttccaagtaggatggaagctccagctttatacttaaataatcctcatcaacatctaaaagatagtgataattaaatctctcctatctaactaaaatggaatgttttaaagcttaggtaacaattctgaaattcttaattccccccaaaacaaactttttctgagcacattttgatttcttattcccatgccagaatagactgttttgtatatggtatcttccaagatattttcccactgagttaacttctgaaattgcttcttccaacgcataagcaataaacaacagattcgtttttacattctcaccttagctattgcatctctgattgttttcatctataatgagactttctatactttggccagtccttctgtttttcttaaaatgtgggaccacaggccaggcacggtagctcgcatctgtaatcccagcaatttgggaggccgaggcaggcggatcacctgaggtcaggagttcaagaccagcctggccaacatggtgaaaccccatctctactaaaaatacaaaaattagtcgggcatggtggcgggtacctgtaatcccagctacttgggaagctgaaccctgagaattgcttggacccaggaggcgaaggttgcagtgagctgatatcgcatcgctgcactccagtgtgggcaacagagcaagactccatctcaaaaaaaaaaaaaaaaagtgggaccacatactctaagcacctttagacaaaaccacaggatacaaatgtaatgtggctaatcagctggtcttccaccacccacctctggagcatggaaggccttgtccagccttgccttgccaagccaagggtcatctctagtccactgagcccaccctctaccctagcacccctcctgtcccaagagtcattgaccctcaggtcaagggataccagagccactacagtgaggctggccgtgtctctgaaatattttctttttttttttttgcccttctctcttcctcggcgctgcctatggaggtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaagaaagaaatattttctttcttttctttttttttttttttttgagacgcagtctcgctctgtcacccaggctgaagtgcagtggcacgatctcggctcactgcaagctccgcctcccgggttcacgccattctcctgcctcaacctccagagtagctgggactacaggcacctgccaccacgcccagctaatttttttgtatttttttaatagacacggggtttcaccgtgttagacaggatggtcttgatctcctgacctcgtgatccacccgtgagccaccgcgcctggcctgaaatattttatttttgttcatctttgttgtgcttataatactcctgttttctgtttattcccctgacttgaaccagatgttaggggagtatttgaagctcctcgttccctctcttcatcaatatcttctgtctagaaactaaccaagcaccttatctggctccagacctctcagtgatctgtgggaggccaactcgcaggatttcagcagagtttgcactttctaggcctaaaagataagtccttccatgtgtaagttcagattaaaggcaacatattgcatttacattttagagaggtgaacacattattttctgggacttaagtgttgttttgtttcttttttttttttttaatgtagtttatttctctttctaagagattacaggattcaagaatggcaatgaatcttaatagcctttgggagaaagcagcaaagctttaatactaagttccaggaccatgaacttccatgttgtcctaaatgcatttttcaaacattgctttctgtgcctactctataaaacctaaaaatccaaggtgacagtattccttatctaaaatcctaaacaaggctgggcgtggtggttcatacctgtaatcccagcactttgggaggacaaggcaggcggatcacttgagcccaggagttcaagaccagcctggccaacgtggtgaaacctcgtctttactaaaaatacaaaaattagccgggcatggtggtgcacacttgtaatcccagctactccggaggctgtggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 403 - DNA, 81526 bp, Homo sapiens
cgagctgtgccccacgctcccgctgcaacagtcccgggcatcgcagctgccagtcaaggctaggaggcggtcggggactccgcctcctcccgacccgtaggtctgggagcgcaagtcctgttgcagtcttgcaaagtgtaaagctgtcagccgcagagcacggaggaaagacggagagaatggaagagctcctgtccggtgtgccagcagcccggactggcggtgagcgcgagggaggctactgagaagcccggcgacggaggaacgcaggtctgctgccaggtaggtttagcgagctttttaaaggctacaggcgttgcaagaccggaatggtgttgctggactaaggaaaaaggacaggaaactcactgtgacaccacaatttttcgattttctgtctctagtgctcaaaccatacagaactgaattcattctgaatgccttaaacacctgttaacttagaagaaaaatgcctttgttaaaggaaagtagtttcatttctaataaaacagtttctataatagaatgtattgtagaatccgagattagaccagacctctccctaggtcttaaggggagaccaaaagttggcataatctcggattatgcattatagtgcttattttatcaggtaattgctaatgaaacagtgaaactctgatactacgagagccattctcaaatttaagttaaaatcgaactgattgtcgtttgtgcagggaaaaggtaggtatcttttgcttattctttctaaaacaccttttgtttttctcatgagtttcaaggatcctgctgtaagtctactcctcatgcatatacactattcacataaagatttcccagaaattaattcccttctctgggaaatgttcttttttcatgttctcataacagactgtcagtttcatattgctttctgccacatgtatcttatcaaaacattagctctgaggttcttaacaggactatctctgctcttccgatttggcatttctggacgtttatttgaacattgagaggtataaattaaatggcaatgtatctaacatttctgaggaagcagattagggggtgtctgtgcccagaagcaaaataaatgaactttgggatgactcagtttttagggtgtgggtaagaggcaaaaggaacctagccagtcctaactgagttgctggctaattagagtatctgtctgccgcagctttcactgaaatgagcctcttggtccctttcacatcaaatccctctgtgagtccctccttctccttagtttatctttccttcacaacctgggtccttttcatggacagcagtgccttaaatacttctaaaactatcctgagggggagaaaaacctatagcagatccacaaagccacttgtagataattgtattatgaaatccaaggtcatggtttcacacaactcctgctctgcccttgcacacctttgactggcatttttttttttatttttgtcgtgggcataaacttagaaaagtgggaaagggaaaaacctcagtttcaaaagtagtctctgactaattaattatcttgattaaaaaaaggtaaacatatatagtgaacgtgaaaaagatgttgagtagtagaattgggttgcttggctttttatttaaaacaaacaaaactcaaccaaaaaaaccccccaaaaccccaaacaatcaccctagataactttctcctacactactgtgctggaagtcgggcttgagtgtggtcaaatcctgcccatttacccagagttttacaaatatttacagtcatctatgccaaatatctttgtgctgagtcccaaagaacattctcagcattcaaaaggcccattctcatgaatggtttcagttcattggcaatttaaaggcattcaggcttccaaactaggtcagcttaagacatgtctttttaaaataatcagtttttgggtctcagattatgaaccaggtttttggagccaaactctacagcagagagaagagtatgctctctctggaaagaaaaagcttattttatctacctggtatgaccatttaacttcctgaaaaacgtctttctcctcagtagtatgaatatttttcatctgaggaggtgcacttaaaatttccttcttgaaaagtcatttcaatattttagacgtttagaaacatttatatgtatgtcagaatcctttctccgaagtgtttctgctaatcctggcttctttgtttcccctggccttgactttatgacattactttcttggagagtgaagtttttagtgtttgaaatctccagtttgagatagaggtcaggaatcatgctgaacccagatgttactgaaggaacaaagtctgagcagttttgggactaagcctactttgtacaactgattattttggatgtgggaaaagggccaagctgccagacaagtcatgcttttcacttggactttggggaataggtatctgtagccattgctcctaagtactgaaacatttctttcaggggtgcctaccttaatttatagaagctccttacctgaaacaaatggtcaatattttcagcttgtgaatttctggaagtgaatacagatgagaaccaggcctttaatattttctctcctccaagtacaatcagaaaagttatccactctactactgagtgactgatttgctaggtgctaggttagatgctgggatataaagatggctaagatgtggtctctgtccggaagaaattctcataaggtcagaagtgacttgggtctagagtggtagttctgaattcacattgctttgccagattataaaaagtacttcgatgtttgtcacctcgatcatcttaattttcttggtagtgttaccttgaccatttgaccattaagaggtatatgacacctaagttaatttatgtaaatattttaattcataatttttacctttaggtgtatgtgggaggtcttggactaaagttttagttttattaactttggcatttgctatttacccagtcggtgagtactttggaacctaatgcatcataccatagttgttattaaaaaatggataactatatattaaatgagtaaaaatgaccaatgcttctgcaacgtggaatgaggatcttctcatctatgagcagatctctttcttgaattcaaaacacagcaatctaagtgaaatagacttttcttattcatagctggagatacttctgatcacatggcttggagtatttattaagagcatactttgaaagccatgtcccattgttttctaaatcttttgaagtcacgagtttgagtcccagcccttcatcaacttgttctttgtttttcttgggaagataaaacaagacaactcgtttctgtctgttgaacttgtggctgaaaccataaacccacacattctcctgcatatgattatatgaaatcctctgttgaaaacctcctcaactagttgactcttaataagtaggagctgggtttaatcacctttacatccctagcacctaatgtgtagaatttgttctttgtgtgttgactttgtttccttcatgataaattcctgttataggaaattaattggcaaagacatacaaaaatctacacctgcactttgctcaggtggggtgaagattcctcttccaaactggtttccaatttgtttctaattaaaatttctatatgaaacttttaactttaacaggagggggtaatattggcacatgcttttattcatttgaaaaaaaatttttgatttagatattcgtgctttagcggctctggttttctggtaatgtcctgacccaagaaatcagcctggctcttgctctataaggctctttgaaataccacttctccttgattggtcaattacatcattgtctgacctgcctttaagtggcgttccttcctgcttctgagctttgttgttatgccaggcatagggaagaaaattatttagcagggctgtgtgaataattgtgggaggcagggaaccactgattaaaacaggagtgggcaaggcacagtggtgatattgaagaggtagctaccatgatgaatgcaaaattgccatgccaaaaatatcattgagctgttattctcatattcactcccaccttctttgataagtttatattgtttggaaaactgggaatggatttctacctcttgggccttaccctgtagggtaatgagaacatggaaagaaggcaagaagaaatgtgcttttaagaaaaagccagttgcggtggctcatgcctgtaatcccagcactttgggaggctgaggtgggctgatcacgaggtcaggagatcgagaccatcctggcaaacacggtgaaaccacatctctactaaaaatacaaaaaaattagccaagcgtggtggtgggcgcctgtagtcccagctactcgggaggctgaggcaggaggatggcgtgaacccaggaggcggagcttgcagtgagccgagatcgggccactgcactccagcctgggggacagagccagactccatctcaaaaaaaaaggagcagcagtttgcaaatgttaaaactagatgtgccaagggccaggcgcggtgacttacgcctgtaatcccagcactttgggaggccgacgcgggaggatcacggaggtcaggagatcgagaccatcctggctaacatggtgaaaccccatctctactaaaaaaaaaaaaaaaaaaaaaaaaaaattaggtgtggtggcaggtgcctgtagtcccagctacttgggaggctgaggcaggagaatggcgtgaacccaggaggcagagcttgcagcaagctgagatagcaccactgcactgcagcctgggcgacagagcgagactccgtctcaaaaaaaaaacgatgtgccagatgttctgtcctctgtaggatttggagttagcttatcacaacgtcatgtacattgttggccatgcttggacatcagcaccaatatatattttgtaagaaaaaatattagatctcactaaattagttgtaacagactttattcataacctaatttcaagcagcaaagagattgtttggaaaacagttcttgctaatactttaagatgcttctccttcctgatgaagtgcctactttttttttttaacccacaaaaaggttaatagggctatatttgcatatcagttccatttttagaaggttaatagtctccaagttacaaagttgtgatctcattgccatcctagaaactgttgaaatgacgatgttaaaactaagaaattatagactaaataaagtgctttttgagcactttaagccatgaaacagtggcgagaaaacagaagtcctcttctctaccacaggaggcacagtgatacaatactgccacctcacagagcctgaataggtgaatatttactttcttacatctaagacctaaatatttcctgggtttgtttatgctagaggatattttctaatctatttcattttttcaaataatgacaacttatgtgtaatatcatgtatgtactcattgagtttgagcattattcttttaaaaagggcagatcatgaggtcaggagatcaagaccatcctggctaacatggtgaaaccccgtctctactaaaaaatacaaaaaattagctgggcgtgatggcgggcacctgtagtcccagctactagggagcctgaggcaggagaatggtgtgaacccaggaggcagagcttgcagcgagccgagatcgcgccactgcactccagcctggagacagagtgagactccatctcaaaaaaaaaaaaaaaaagtaattaatagatatacagtttatttaagtaattgcagttccctgactacgagaggggcagcctatgtttccatttgttcatgtcctcttaggttagggcatgcattagaactgtttttctgattgaaagaatgtacgctggttcatcttgtccttgaatgaccagagagctggttggagatgcaagcggagagtagagctacaacactggccacaaaggaggtctaccataagcccttgcttccttcattgctgttgctactgctaccagccagcaggtcaccctgccattgtatttggattgtatttagggtagaacttcagctaatggctgataatgctcagcactttactagactcaattagtaccattgggttcactaatagtttctgttaggaaaaggaaccagtagctaaccaaactactctattgggcagaagtaccaagatcaacataatgctgattttcagattgcattgagtggaaactggttgcctggtgtgttcttagctgatatggggatagctttcctaacaaggcaaggatgggacctttagattgctgctctttttttctgctttattagaatattagcttcccgagaatatgtctccattttacaaggcaacacttcagcctttcttcatcaccacccacccttctcaaaaactttcccctttgctacctccctcccatatttatgcattcatatctgttattctagctacttcacagtgatgactcgatgtctcacaaaggcatataaacacattgagagtatacatatgtctcctcttctgtttgtcccctgtacttgagtaactcttagaatttcatagcatagcttggaattaagacctcagtgcagatcaactggatttttatttacattaatatcctgtggcatcagtaatatctagctgattcattttagtagctttctatttctcttagtctccttagttgtgctttagcagtttctccaaattttaaagtttctgcataataaagtaaaaattccaaaataattagggataagtgtcctaataataattagggtaagtatcctaataaaacattatcccttccaattacactatctttttgtgtaagggaataactgtgttgattttggataatcaaacagacataaactacattggttaaaaatactttgaatagctgggtgtggtggcttacacctgtaatcccagcactttgggaggccgaggtgggcggatcatgaggtcaggagttcaagaccagcctggtcaatatggtgaaacctcgtctctactaaaaatacaaaaattagcccggcgtggtggtgggcacctgaaatcccatctacttggaacgctgaggcaggagaattggttgaacccgggaggtggaggttgcagtgagctgagatcatgccactgcactctagcgtggatgacagagtgatactccgtcccctaccccccaaccaagaaaaaaaaaaaaaagctttgaatgttggctctcccatcatttgcatttttggagcagattgctttttcaggccatcagcagaatatgaaaattccttatacattctgtgctgaagtattcccttctttgacaattctaatgacaagacacgaggggaaaggcgactttccattctttcctatcagatagtacttgcttctcatataatgaacactttatagtgcaagagacacatagagcaggtagaactgctggttctcctttcctggtaatttagtgcaaactcagacgtttcagaatggctttccttccttacatggcccaaccaatctgtcttgttctatgattaggtatatataagcaagtgatacctgctaccaaccttagaatgcctaaacttgaaaggcagctgtcagatttcaaggtgccccttgcattctctgccaaaattcttttcacaaggggttcttgacactcggtgagaggcacagtcacatctataatcactgtaaaagtaattataattgttagcttttaaaatcaagtggtagggtggataattcaagtcactttcttatttttgatagaaatgtgaggtatgaggcagtaggagtgagttagcctctttctggaatgaagacttttcttgaaacctggaggggagtggatgtgaattgcttgtgcccctgtgaagttgtggcccaatgggagggacaggaggagctgggagtgtgttatcaaatgccctgagcttcctgaggctctactattgggggtttcatgctgtgaagaccggtgaatagtaatatgacacaaaggaagaaatgcaaggaaaccttggagccattcacaggcatctcaggtgtggggaaattcattagaggctttcaggattctcctgtttactgattgaagagctcattttgcaatgaatcaatggtgaaaggatttcttgtttgatattcttttttttttttaaatgaagtgctcactgcatttcattcatttttttaactatccattgttggttttgcccaaagtgagaaacgaaagggttggtttttagtctgtgcatggtgcaggtttaggcttctgcaatggtgcctggggggctgctgagtggggaaggtcaaggggactggctctggacacccactattgggtgctggcacttgtctacctgaatctcttttatacagtggtggtttgactaagatttttgtttttgaaagctcattgcttgaaaaatgtctgagagccattgctttagggaattggtgttattgtacacagaaaaataaatcactttttgaagaatcattttggattgttcacatctcaaggagatgaaatatgtaacttttttcctctatgtcactgagtcataagtcctgcctttttggaatgcttggaattttttaaaaaacaaaatgcatctctgctatgtaaaggtttttctattataaaaattacatatgttttttataactttgacttcatagcctataggcatgtaactccttagttttaaggagtaaaaacttacgtactgtttatagtaagagacaattatgtttcacatggtcttgattaccacaatttttagttctaccttcaaaagaagactatttctaagaaatatctaattataggtattccattatggataataattgaggtattattagaggaatccaatatgtctttcaagagtatccaattaatttctaagaggtatcccaattatgtctttgtttttcaagagtacattaaaactttggcctgtttaatatttccttctaaaaaaataatatagagtaagactgagaaatacttggatttctcgaagagtacctagatctcttgctaggtcagaacaacaggattggctattcacaccagctttctccacatggctaagtgtatttgacatttggggtgtgggatggttctggcctgtgtcattaccctttttctcctactcaggaagcatttactacctacgtttcttcttgttgttttacttgggatttctcttgaaagaaagataattcagaatagattgcataagcagtgaagcagcgttgagaatgtacaggtgagaagacaacagatgggaagttggtgggactgtgtgccatgagcccgggagtactggagacgcaagctgatgacagttgtttaagcatgaactgggaggaaggaaaaggtaaagtcattcatttttacccgtatgtttatcataaagagagattttttacaaaaactcaaaatcctgaatttgacgtgcaggtctatttgaatttaatttgctcttggatgacagctcctcagtagttaatggaataacgctgtgtcttgaactttatccggcatttgctgagaaaaaaaccatgtcttccacatggaaactaaccattagttagcttcctatttaattattttgaatcaggttttctggtactgagtactgggagtaggtgaaaaaccttgaatgcttcaggttgctcgagttagtaatcgttgactttctggtatgacattaagaaagtggatgtggacagattgacaagcaaatatctcatttatttttttccttttctatctaatcgaatttgattttcccctacttgttttagtacttttgtacttacatattgagacttaagctattgttgggagtaggtagcaaatgattacatgtaatttcttttgtctgaaaattaagaggaaaagagcttggttcttgtagggggaggtgtatttgcaattatttctatggcagaatttattagaattggccactctttaaaaatagtaagaactataggattttgcttttgtttaaccagaacatgaaatttccagatgtgatataaaatatgaatatgtggagaaattattttcacaattatttagtctcttttaaagataaagattcagaataaaaacaatctagtagaagaactttggctgtagtttttatttttcagtctaaagatgtcttttcccatggtcatgctgtgtggggagacaaattttgtttctgtgcagcttcagggaccttaaggatagctgtagtcatggacttcaactctcttttcctctttctgtcccccttcctccttcttttctctgcttcgtctgtccatgtgatatccacacaaggcagctctggtgtaatggatctggcactgggcttggtggcctcagaaggctgaggattgtcttctgctctgccatgtacaagctctgagaactttggcagattacctaacttatcagtatcacaattaatctataaaatggggaaaacaattatttcatcatcccaagcagaaactctgtacccgttgaacatgccaggtgaggaagcataccctgactcgggaggtggagtcgggagggtcatgtcagtccaggagttcgaggctgcagtgagctatgattgtgccaccacactcgagcctgggcaacagagagagaccctttctctaggaaaaaaaaaccccacaaacagtaactcttcatttccccctcccaccagcccctggtaacctctattcttctttttgtctctcagaattgactactctaggtacctcatttaagtggaatcatacaatatttgattttctgtctggtttatttcagttagcatgatgtcttcaaggttcatccatgttgtagcatgtgtcagaattttatttctttttattccactgtatatatagaccacattttgtttgttcttctgtctttttaattttttattttttgagacgtttcattctgtcacccaggctggagtgtggtgacgcaatcttgactcactgcaacctctgcctcctgggttcaagtgattctcccgcctcagcctcctgagtagctgggattacagatgtgccactgtgcctggctaattttgtatttttgtattttttgtaattttgtatttttagtagagacgaggtttcaccatgttggccaggctggtcttgaactcctgacctcaagcaatccacctgcctcggcctcccacagtgctgggattacaggcatgagccactgcgcccagcctcattcttctgctgatggacacttgggttgcctccactgtttggctattgtgaataatgttgctatgaatatgggtgtacaaatatctctttgagaccctgctttcagttcttttgggtatatacccgattgctggatcatatgttacctctttgtttaactttttgaatgacattctattttaagtactttttgagtctgttgaattgattgtagtgatgcaactcctaaatatgtttgctcatagtgatatttcccgcccctgaccttcattaaggtataattgacaaattacatttgcagtatacaatgtgatgttttgctctatgtatataaatgcttaaatcaagctaatgaacatcatcacttcacatttttctttgtgtgtgtgtggtgagatcatttaaaatctactcttggccattttcaagtatacagtgtattattactaactctagtcaccaagctgcgtgagagctccccagaacttattcatctcatctaaatgaaactttgtaagcttgaccaacatctccccattcccaccccaccatagtggtcttttaatttccatagctcatatgatgtgaatcaggacagtgaggtcagcttacatttcaggacttcagggataccttgccgaggtaggtgaaccactctctagcccgtcgttcccagaaatgcattagctgtaagttttgggataactgagggtgagaatttgatcagctggcctccagacgtgttggctaaacaatagctttatcaatccatataatattttctgctttggacctttctatagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagctgtgagttttccttgatgctttcactatgagaaaatacaaagggaaaaatcataaaagtaggatatatttctgtggtttactgagaaaccagagtgtgctacaatatgatcctgctttggaaagcatttcatatttgaacctatttccaaatagtatcttaaatggtaaatcctgggtttacttgttttagctgagtataatttatgtttgaaatttaattattggttgaataaatagtctttctgttaaggttcaaactatggaacagaatagaaaaattttaacatgctggccaggtgcgttgcctcacacctgtaatcccagcactttgggaggccgaggcgggcggatcacaaggtcagaagatcgagaccatcctagctaacatggtaaaaccccgtctctactaaaaatacaaaagaaattagctgggcttggtggcgggcgcctgtagtcccagctactcgggaggcggaggcaggagaatggcgtgaacctgggaggcagagcttgcagtgagccgagatcaggccactgcactccagcctgggcgacagagcgagactctgtctcaaaaaaaaaaaaaaaaatttaacatgctgtagttaactaccacctataagaaactcaccaggtattttaaatgatggagaagtcaggtagtaatttactttatgtactgaattttcattcatatacttgttcatcttctacaatgtacatgatataaattgtactttgtcatagctccttttatgctgttttcacagtatgctgaatccttcttattccacttaatgagagccctatagacctgcagaagtgggcttatctcttttagtgtgacacctggtatcaacacctgtgacctttactgccacttttccttgaaggttggtcggttaaggtataaaggtaggaaatagattgagttcctgtaggcttcagtgatgacacagaatagcattgttcatttaatcaacaaatatctgttgagcaggaactatgtcccaggaatggttctaggcacgaggatttatcagttaaggaaacaaaacccagcgaagtttcttgcttttaggagcttatattctatataagaacgttgtgtaggagttcagggcttagaggatgttgctgttttaggtagggggatcagaagtaggccttgctgaggagtgatgtttgtgctgcctctccttcctcttgttgttagtgtgtgttgctttataggaagtgaggaaatggccttgtcatctcagagcaacttcagtttcctttggtcttgctttgtttctgaaggctgtccttcaaaacaattatttctctgactttctcacccttgctgcagacccttgctaatccttgaaacaaatgagtcagaagcaacatgtggtgaaaatcagtatgcaaatatttcactgagggttactgctgtttaaaagaattcaatttttgctatgacatttaacagtgcagaatttaagcgtgtgcgtcaacattggggaaataatacatggtgaaggttgtatttcatcttctcagggagctaacactgtcctgttattgtttcagtagattttagttcctgattcaaaacagcatggctgcttctcatttctctttcagcaatttgagggtaggagttagtacagttagctttttcagtcatctagattcacacttcctcattgttagggagtgctcaaaagcagagagtcaaatggctgaatgttttttggtatccctcaattttggatccttttgcacctagaaacattaactttccctggcatcctgttacctgttacctgtgagctgccaaaatagtaagcggtgtatgattacattagtgtctgtaaaattgtaatttgaatcagattcacctgaaatactcctctaactttcttttggttagagatttatttcttgtttttaaaaaaatgacttaaaatgtgtctaatacttcccagactttaatttgcatctgtattcagtatcaaatgttttgtattttcgaggctgaaaagaaatttgtaactttttcatatgccacatactactgacttctacttttaaacagaattggatgacatctcccaattgcttgtgcctaccatatatttaaaatggttttactgagaaccacccccctgccccagggagtatccacatgtaatgatcttcctgctagatttgatgttatgccggtatatactggtatatgtaatgtatatattttttcttttcatgttagatggataatgtgcttatggtgtaaccaggtttgagggaggcatatctcatgtgactgggagaagccaatcatcatgcttatgaactacaagaggatctatactggtatattttcttggatttaataaagctttaacaatattctgtcattgtcctgtcttctgtaagaggcatccctggccattttgctgtgagcctagctttttttgttgttgtttccaagatcaccacactccaattccaactctaccccaactcagctgtgtaattgggcacatgattaatctctttgggcctctgatttctcctgtgtaaaatgaaggtgctaggatccttcacagtgcttcaaatagggggtgcagtatactctgggtatgcagaagggacagatgtggagtatctgacttgaccattgaatgttaatcagttatttccttatctttagagagacctggcctttaaatagatgccccaagtgtgttccacggaccaccagctctgggaaacagagatatccttgaatgaaatgttccatggtcaaattagcttgggaactgcaatgttcttctgttcctttcttagagggatgtaaggcacatttgcatattagaggctctgtgaaatcttgtggttaaagggaaagcaggggaatcttgtttagcttcttctgatgaagcatttccctttgaccgtgccacccttttgagtggaacatctattgcccacaaccagtgctctgaggaacactgctttaaattatttcatgtaggtaattcttgatttaaataacatccagggaaaggaatgtggtagatgttgtctcaaataagccatcaatattatctaggttcttgttaaaggatgttctagctgtgaagatggtttctgctagactgtttgctcagttttaatatgcagaataaagtgtaatataaagcaagagaagctgcatatacaggaaaaattgggcatagttcttactggcatgactgacgtcatagaacatgaggtgtattacagatccaaagaggttgatgtcttggggttacagagaaaaagatgtagcataattacttgttctattttgaaggttaaatatctcagggatgtttgtctgtttatgacatgcaaagagtatctgtctctcccttcctctcttttgcctgtatatttaaataacccaaatatgaaaattctaactttccttttctgggtttgcaatgcgttctttcagataatgccacataatgttaattcaagcgaaataaattcacaagtcagttatcaaagtaatggaaatttgtgagtttgctcccttgtgtacaatatttgcttctgatttattttagaagtgatttctgtcagccgtgaattaaggaatagtgaaaacacagttgttgcttgtttttataacttagataatttcacctgaaaagagtcggtatgttgggcatggcctatttacctttcagattaaatacaggatgtgctaagcaaaaagaaaataaagtccagccatattcttgccttttttccattacgttctattggctctaggtagttagaactccttttactattcatttcttggagccaaatggattttccaatgtttaaaaagtgagaggaaatataaaacattttagaccaagccgttctttcccttggggcctgtcgggtgacctttaagaaaagcccacagttggtttgggagaccgtcttagtccattttgtgttgctataacagaatacagaggctaggtaatttataaagaaaagaggtttatttagctcacagttttgcaggtggaaagttagagaagcacggtgctgacatctacttggcttctggtgaaggtctcatgctaggtcaaaacacagcagagaaggtcaaagggaaagtggacatgtgaaaagagacaaaacccaaggggcatcctggctttctaaaaactcactctggcaggaactattaagaattcattcccgcaagaactaattcattctcgccacagcaagaactcagccactacctagagagtggcaccaagccattccccaactaggtcccacctcccaacactactacactggggaagaaatttcaatgtgaattttggtggggataaacaaaccatatccaaaccatagcagagacatttacagtttgggaggatttgcaatgtgtatgtgcacacacagtttggtaactttcaaatgaagcatgaatctgtggtggatctttcctgggttctaactgttacctgcattaggagaaagtaatgccactttcctatttctacctctgtttctcccttgcagtatagcatagtgtgttagaatgcagatatggagataagaagactcaggctcaagttcaggctttgtcatttgatggtgtatgatttggggcaagttgtttgccttctctagactttagtttctttgcctgtaagacggagggagggaggggttgacaatacctacctttatttcctaagatccatcagtgtgctgagctgttacgttcttcaaaaagatttcagagaaaggaaagcctataatgatttgactggcttcctcactagccttttataaaaaggtggttatataggtaattacaacctcactgctattctgagatactcagagattagcagttaggatagagagaaatgtctcttttggatttgttcaaagtgtggctttgaaatatttaaactaaatatctagaattaggacttaacagggaaaaaaaagtgccaatacaactttgacagtaaatagatgagcacatttatggtggatataaaagattcagatgaaagggtgtttcaaagtaccacatatttaagaacttgcttacttccaagaacataataatataattacttgttggcttgatatgttagtctagtatcattttaagttccttttattgagaattctctggaaccacaagaaataatgagggatcttactcaaggccaatgccacagaatgattctctgtcccctcttctggtcatgagacctgccaacctttcccaaagctttcaaattctccagctccagattcccacgtcttctactactattaaatgggccgaactaagttctgccagttcaaagcactgtattattctgttggtttctggtacctaaatatgcttgcttgcaaggttagtttttttctttattattattattattattattattgttattattatttttgagatggagtcttgctctgttgcccaggctggagtgcagtggcacaatctcggctcactgtaacttccgcctcccgggttcaagtggttctcctgcctcagcctccggagtagctgggattacaggcatgtgccaccaggcctgactaattttttttgtatttttagttgagttggggtttcactatgtaggtcaggctggtcttgaactcctgacctcgtgatccacctgcctcggcctcccaaagtgctgggattataggcgtgagccaccgtgcccagccgcaaggttagttttatgctttcccttaactttgcttggggtggttagcagtaaatcagtgaatttgtctttgtttgtgaaataacttcaatatactcactgcttatatccattaagagatttaatgacaatactatggtgacttttgtatttattggtcaagtcacaggtttacaatgccgattttattggcactatatttttccactgacaacggagccactgcagggtcagatggcatctgtggaaaaagagcaaacagtaacagcatgagaaatggattagagatgactcaaggaggagctggcttcctggacctatgatctcatccatgcctaatgcttaccacttacttattcaaggaaagtagtaaaatgtggcaagagaggaaagaacagcagaagaaaaccatactattaaggccctaatgtctttgtcatagcatcatagtcctagaattgtaagtgaccttagatcttctagttcccccaccctcctaatgaaagaagtcattttctgggatgccagtatggtttggcatttaagagaatgggtctcaagtttggtagcttaggctttatttattcaacaaatatttgctgtgtcttgcatagttctgatggtttgaatatagtggtgaacgatcagattaagccctggttttcaaataactcaacttttcgtatgagacatagatgctaacaagtaaatacagaagtcaggtgatggtttgtgctatggaaaaatagggtgaggggggtcaggagtgctgtggggaagagggacttctactttattagatgatcagggaagtctcagtgataaggtgttatttgagcagagacctgaaggaaatggggaacaagccatacagatatctgggagaagagggttgtaggcagagggaagcagtatggaggtcttaagttgggagtgtgcttggtgtatcctgttacagcaaaggaggctggtgtggctggaaaagtgtgtgtgtgtgtgtgtgtgtgtgtgtgtgtgtgtgtgtgtgtagggggagtagtaggagatgaaggctaagtcccatgatcttctctctgcaagctggagacccaggagaaccagtggtgtatttccagtccaagtctgaaggcttgagaactaagagagccagtggtataagtcccagtccgagggcaggagaaaactgatgtcccagctcaggcagtcaggcagggagacgaattctttcctccttttgttctttttaggcccttaatggattggatgatgcctgctcgcaatggggagggtaaactgctttactcagtttaccgatgcaagtgctgattgtattagtctgttttcacactgctataaagaatacctgagatctataaaggaaggaggtttaattgactcacagttctgcatggatggggaggcctcaggaaacttacaatcatggtggaaggggaagcagccacgtcttacatagtagcaggcgagaaagagagcaccacacttatcaaacaaccagatctcgtgagaattcactatcatgggaacagcatgggggatactgcccctataatctagtcacctcccaccaggtccctccctcaacatctgggggttataattcaagatgagatttgggtggggacacagagccaagctatatcactgatcttatccagaaacacacacacacatgcccagaaatgaggcatataggaggcatcctgtggccaagatgacacacaaaattaacctttatgcatagagaataaactacaggggccagggtgaaagcaagaagactacttagaaggcaaacgtaataatccaggccagagatgatagtggcctggaccagcagatggtaggggttaatgtctttgggcagtctattgggtcattttctttcatgtaatatagggataataagaaatcatctcacaagattatatagaagattacagtagataatctagataaattacttagtacactgccagaatacagctagcatatatagctctactctttttagtgtggttatctagcttttgactgataatttccaggattgggacataccatagtactgactattcaattattggaaatttctaaattgaaaccatctttgctctacattcatttgaaactggtttctatgtaaattctaactattagcgttacttccactctctaaaataaaattggttagaatctaattttactattcctggttgaaatctaattctactcactagctgcatattatttgaatgaaggttatcttttttttagagggcggacgtcagattactcatgaaaaattctcctatagtgctcagtccaatgtaggaaatagtgagctatctagtagtgagataagtaggcctgctattagttccaattctgtcaataactctatgactcgaatcaagttatttctctagaatttcctcatttgtaaaaatggtggcttggtttggaatttttctttttctttctttctttttctttttttttttttttttccagacagaatctcattttgttgcccaggctggagtacagtggtgcgatctcagctcactgtgacctttgcctcctgggttcaagtgattctcctgccttagcctcctgagtagctgggattataggtgcctgtcaccatgcccggctaatttttgtacttttaatagagatggggtttcaccatgttggtcagcctggtctggaactcctgacctcaagtgttcctcccgccttggcctcccaaagtgctgggattacagatgtgagccactgtacccagcttgagatttttctaaaaccatgatttctttttcttcatcattttctcttctttaagctgagaatcctcaattactttaaccagccaaattgttttcctatgggaggtttcagtttggtaaggaagatatatcattcatcttactagttactattttaatatgcatttatcttctacatttaggtcctgtaatcaaattagcatgatcttattctattttggatggaaacatgactgtagtggaaactgtggcattcactcggatccctcttcagggcaatgtttctatcctccatttcccagggactggcttatggaacaatgactgattgctacagggatataaaggtctttccctttcagcttaatgaggtgccgctgcgaagggcccttcctaccttgagagtaccctgttggaatgtagggccagatcagaccctggctgcagctgcatggcgggtcaggatctccctctgcccacttctattctccttacttccttataggcatgactttggtgagagtataccccatactcttctaaatggaattctccatccctgaatcaatttctagggaacacagttaaagacacaaatccgtgaattattatttttcttctggtaatgcctccacctatatagtccagaaaagtgttttttttttttttttttctctgcaaaatgagcatctcatgacctttacagggtctgcctttcatcccattgcctctaagttaactaataaagtgtgatatattccttaagtgtgttatattcctgctttattagtatatttacacaattctatagaaactggaaaatttggctaggtgtggtgtctcatgcactttgggaggccgaggcgggtggatcacttggggccaggaatttgagaccagcctagccaccatggtgagaccctgtctttactgaaaatacaaaaatttgccaggcacagtggcgcacacctgtaatcccagctatttgggaggctgaggcatgagaactgcttgaacccgggaagtggaggttgcagtgagctgagatcttgccactgcactccagcccgggcacctgagtgagactgtctcaaaaaaaaaaaaaaaaaaaaaaaaaaaaccctggaaaactcttctttttctgggtagatctctttgaacatactttaacatatcttaccttcttgccataggtatattaagaaatagtaacttatgccctcccccaccctcttgggttgacagaattcttttgggacaaacttcacttgcataacctttttttttttttttttttactttttgagatggagttttgctcttgtcccccaggctggagtgcaatggcacgatcttgactcattgcaacctccgcctcctgggttcacgcagttctcctgcctcagcctcctgagtagctgggattacaggcaggtgccatcatgctggctaatttttgtatttttagtagagatgggatttcaccttgttggccaagctggtctcgatgtcctgacctcaagtgacctgcccgccttgtcttcccaaactgttaggattacaggcgtgagccactgcgccccggcctacataacattttttacttcgatcataggcgtaacaagtactttaggcttggtattcgggtaaggggtgatgttataatgtggaacagaattttatttctttttacaaaggaagttgtgaaaagatagtttggtgatctgtgcttgtatgttgtgtagacttttccccccttaagcatgcctttgccaaagtttaattcttcaaaccacatatcagaatgtaataggctggccaaacatgcaaatcatgaccagagagcaggcaaaagttggtttctgatgagagaacttttccattgttgccactaagtcaccaaagtttatgtatttcttcttttgaagttgcacccttattccaatattctctaagtctattcccacctttgtccagactctactgatccatttggtactagtgtgtgccaggcatggtgttaattgtggagcaagtggcagtcatcagacacaaccagccctgctgttatgtgggcagtagaccctctgataaaggaagtacaatatgttataaagcatacagaaacccacctaaaatagactcagggaggtaggaggtttcctaagggctgagactgaaagataatagggattgcttgatggcattgttgatggggctgtgggtgagaacagtgctccagggaaaagaggccagccacatgtgagaacacagaatcagggaagagtgacctgctgaggaaccaaaccggaagatgttcctgggacacattgttggaagtgtgggtgtgctcaggcaggaggccagagaggcaagcagagactagatggagggcctggtatgctgtgttaaaaaaacattatggagccactggaaggctttgtttgggaatgagatagggaggatggcgtcggtacaggatagagaatggactgaaagtgggcaaggctggagcaggaggagggaaccatggcaggctgaagcagagctcggagaacaatgtccttatcaacttaggatacatgtgtatggcagactgcagttttgatgcctggagtatttaaattatttttgtgccccaatttctcttttttcctatccatttgggatactgtcagctttcttttctttttttttcttcttttcttttctttttttttgagacggagtctcattctgttgccaggctggagtgcagtggcgtgatctctgctcactgcaacctccgcctcccgggttcaagcagttctcctacctcagcctcctgagtagctgggactacaggcacgtgccaccactcccagggaatttttgtatttttagtagagacgggatttcaccatgttagccaggatggtctcgatctcctgatcttatgatctgcctgcctcggcctcccaaagtgctgggattacaggaataagccaccgtgcccagtgaaagtacatttttaaaaatcatggctagtactcatagaagaaataggaccctaaagtacaaaataatcatgtttcagggctctcttggtttattacattgaagataatttttaattataaatgtaacacatgctaatttaaaaataaaccaaaaaacctcaaaaagcatgtgcatgattcatatatatatatatatatatatatatatatatatattttttttttttttttttttttttgagacggagttgtgccctgtcgctcagggtggagtacagtggtgtgatctcggctcattgcaatctctgcctcctgggttcaagtgattcttctgcctcagcctcccaagtagctgggattacaaacatgcgccaccgcacccaactaatttttgtatttttagtacagagggggttggccaggctggtctcgagctcctgacctcaggtgatctgtccacctcagcctcccaaagtgctgggattacaggcgtgagccaccacgcccagcccacctgtactttcttctagactctttccctgtgtacttacgcacatcacttaatagagaaatgggatctttaactacagatacttttaacttgagttttacaaacatagtacattgtggacaagtttctgtgcaaaaatatacagaccaaccttcctttttaagtattgtatagtgttctatgatatggttgtatgaaaatttatttaactgggcccctcctaaataatggattttaaggttgtttctagtttttgctattatgaatacattttttttacttatataaatgtgaaaatacctgtccttaggataactttttagaaatagaattgcctaaccaaaatagatgtacattttaaatcagtatgtgttaccaaattactgttccaaactgttgcaccagcttggcaactccaccaacagagtaggaacagaggcctctcttttgacactccgggtattttccaacttttcaccttctgtaatctggtatgtgaaaagaacatatctcatggtttaatccatacttcctctttttaggaggaagcaaattgttgtaagagaagctcatctcatgaatctatctttaaaaaacatacagtatgctcagtgccagtatagtttcaactgattttataccttggtattaatagtaatcaagttagaaaaaaatgggccatatctagaaaagtatattacacatagaagacatgaatgaatgaaaaaatggtggtgttcagactgagggagatgccttatcacacaaaaaaattcatgtccagtgacaaaatgttactaagtaggtaaaggaggtttaaaaaatttaggcaagttgaaaaagggtggtgagttaactagaaaattcagttttttaaaatcccattttctgtatatttcagttcattaaagattggttatataaggcttatctatgtggattccagatatgcagtgtaccccttggaatcaggtgagacacagtgcctcatttccatggaaatacatggctctgtgttaactgaaagcctccatggttttgaatcatttcccacccacagtaaggaggtctttttggtttgactcttctggaaaatatgtgtgaggtatttactacatgaatgtagggtattttttcaatctgcttaaacctcattttattcatctgtttaaaaaaattacggaaggaaaagcaagggcatttgagtacctttcatataatatgtaatatgcaagggtactattttttcccccatttactcttccagtttacagataaaccaattcagagttaaataacttgcccaggatctgtaatgttaatccctacatcatagtgtcgtttggaagaaataaaaacaagctctgtgaaaatatataatgtatggcctagcacatagtatgtggttcctaaattttttttgttagcatgaaaatggatgaaggcccatatttggcttttgtgatcttaacctgaaatgtctaaagcttgacaatagcctataaaatgcaaaattgacaactggctactgattttatatacgtaaaagtttagtcagtacaaaacaaatgtaaagaactactggtttaaaaaatccaaggagtttttcagagaacagaaagtatgtaatcagaatatagtggtggccatggcctcatattagagattgagcatgaacatgagtgttctgtgaactttccactgtgtgatttcgggtaagttatttgaggaaaccaaggccgagacattcagaggtctgatttacacaactggaagttcccagtgcatttagcatattttcagatgttgaaactgaagtcaaggttcaaggccaggcattctgcctcaatgactgatgttctcccaccctccaggcgcattgtgtctgtggaagttactggtgttcttaagaggacctcagtctgacggttgtttccaagtgattcttctgtgttgagggtgtttaatgcatgggttactgcagagcacagagaccttttctgcaaatggaaaaaaatattatagcttaacatctgctttccctaggtaatgtgttaattaaagattgttttaatatggaatgatgtctagcctttgaaaaactttatcttacggtttatggtattgataaccttcagaaaaggaagactggttcaaattatgtcaattaatatgaaaaaagcccactcaatatgaagccccttgacttctaaaaacttgctttttagaaaatgttaaaaaaaattccaggttttgcaggataaatcctcgggggaatattgtgaggtgaggaatagtcgtggtcttgatgcaatgtaacttataattagaaagatgctgattttgctgtggagtcattgaatatcattatttcaaaataattttgaataaaatgagatttctaataaccaacctagtcattgtccaaccttttctactttttcagagttcagttctcttaaatctaagagattctcttttgtaatgtagctcaagaggaagtttaagggttaggtctattcttaactgatgtcccttgttcctatcattccatgtatagaaataatatcttcttgaggaaactgttaagcgtcactctttcccaacttttgggtcattaatatgagctattttgcatgctggctttgtaggttatatcctgtaggaaaaaatgttggtgatgagttagctttattctgtcacttatacagtgttaatattcttttaaaatttcaaaaattcagatagttattaatattgctaccactagttttatttaaaaatgttttaatttgtatagatacgtagtaggtatatatatgattagttttaattaagatattatttcattataatttattcaaactggtttaaatactgagacagattttatttaaaatataggatttctgcttttaagcagtattaaaatctgagatttgatgaatggtataaattttatcttttgcttttagttttaaaatattgtacaacatcctgtttctattcttgaaggtgaaaaagaacaaaaacttttaaaaagatggaaaaaattgtacaacagtttgttatgaaacaagataaagatttttacaacaaatacctgtagagttatcccttggtatcttcaggatattggttccaagccccttcccactccccaccccaaagatacccaaattcatgaatgctcaagtcccttatatagaatggtgtagtatttgcatgtaacctatgtacatcctcccatatactttaaatcatctttaggtaacttataatatctaatacaatgtaaatctatataaatgggttttctactgtattttttgtgtatttcttattgtgattttaaaaatatattttctgtccgtggttggttgaatccatggatgtgaaatctgaggacggggggctgaccgtataccaactatctcttagattgtgcctaagtccttttgtgttgatataacaaaatacgcgagactaggtaatttatcaacaacagaaatccactactcatagttctgaaggctggaaagtccaatatcaacgtgctggcaggattggtgtcccgtgatggcggctctctgcttccaagatggcgtcttactgttgcttcctctggaggggagaaattctgtgtcctcacgtgacagaagagatggaagggcaagagagcactccctttaaccttgagccctttcataagggtgccagttccattcatgagagtggggtcttcgtgacttaatcacctcccgtgggggttcagttttaacgtaaattttgaaggggacaccatcattcaaatcatagcggattctaacattaactttttgcttgctttatcacatatctctccgtctgtttagcctgctgtcctttgcatggtgtagtttaatattcattctgcattctctagtggaatgtgagtactcaatgtgtttgcttagattgggttgaatggttatattttattcaggtgactagcatagccgtacctcatggttgaaggggtttcttgaacctttactaacttgggttttgttttttttttctgtgttgctgggaccttaagtgcacttttagagattcagaagcgctaacagttcaagcagagactctaatagtaggaggaagaatgaaatgacaaatgaattcagtggaatctggctatgctgaatccgtggtatgcttattctcactgcctgtgctgggtctgtgtgctaaggctttggtgtcagctgagggcttacagttctgaaggctaatgtttctttggagaaagtagaaggatgtaaacttggcaagccttcttgttttctttctcctggaatggtcagttacttttctgagcatactgtgtcataagatagcacctgggccagagggatctctttgggattagtataaaaagtggggcctccttctgttaagaaaggcagcacaagtgggacaaaaggaaactcctctgaaaggttaatggatgagtgattgaattactcaaattggaagcagatttttccaacgctagtgccagttcactgctctgattggaatgttcttccattttagcaaatttgtttggctttcttgtgaagcctggaccaggctgcagcatttccaatgggtttctcttcagagctatttctgtcatagagtttcttaatttagatatttcatgatcatttgagataaagatagacgtgtttgatcactcttggttggtgggaactggaggtacttttgattggagtccagatttaatctcccatattgaatgactgtcctcaaacttacaaggtggatcttagtaatcttttccagaaaatgtaacggcactattttgggctaaagtatttaaaggctctcaatcagagttttaaattttgcatatataatttcccccttaagcttcctttgctgtttcttttggaactagctgaatgcttgtattctctatggagaggttgggtagaaaagagtgatgaggggcataaaagtatcttccctgattagaatggagggcatgggtggtactgaactagtggtgcttagacttggttgcaaatgggaatcacttcaagagtttaaaaatattgataacagttcagcaaggtggcagaatataagatcaatgtacagaatcaattgtatttccatatactagtaagaaataatataattgcattaataagaaaataattccatttacaatatcattaaaaggaataaaatatttagggataaatttaccaaagtagaaaattctctgaaaactgcaaaatactctagaaagaaattttaaaagactaaataaaagatatcccatcttcatggattggaagacttgttaaggtggcagtactccccaaatggatttacagattcaacacacctcttgtaaaaattccgactaaattctaggcttatcccaaaattcctatggaaatttgagcaacctagaatggtgaaacaatctggaaaaagaacagagttggagagctctattcctcatttcaaaactgattacagagcgacagtaatcaaaacattgtgatactgtcatgaggatggacagatagatcaatggaatagaattgagagtccataaataaataaataaatcttattttttgtcatttgattttcaacaagggtgccaagacaattcaaagaggaaagaaatgtttttcagcaaatggtgctggacaactggatatctgtttgcaaaagaattaagatgtctgtgatcttcctcataccacagacaaacattaacaaaaatggaccatacacctataacagctgaaactatagaactcttagaagaagaaaacataggaaaatagaaaaattttcatgatcttgggttaggcaagacattcttagatgtgacaccaaaagcataagcgacaaaagaaaaagcagataaattggacttcatcaaaattaaagacctttttgcttcaatggacatcatcaagaaagttaaaagataactcacagaatgggaggaaatatttgcaagtcatatctcataagggatacagctagaatatataaagaattcttacaactcagtaatgaaaacacaaataactcagttacaaatagatgaaagtatagatagttctgaatagggacttcttcagagatgatgtacaaattaccaataagcatgtgaaaagatgctcaaaatcactagccaacagggcaatgcaaatcgaaaccacaatgatattcgacttcacattaagatggctataataaaaaagacagaaaataacgagttttgatgagaatttaaagaagttgaaactctcatacactgctggtgggaatggaaaatgatgcaattgctttggaaaatcatctagcagttcctcaaaaggcaaagatagagttaccatataccatacctactcctaggtaaatatccaagagaaacgaaaatgtatgtccacatgaaaacttgctcatagcagcataattcataataccactcaactggaaacaacccaaatgtccatcaactgatgaaagtataaacaaaatgtggtatattcacacaatggcatactattcagcaataaaataaatgaagtaccaatacatgctacaacatgtatgaatcttgaaaacattatgctaagtgaagccattgacaaaggaccatatattgtatcattccatttatatgaaatgtagagagtaggaagatctatacatacagaaagtcaaatggtggttccctagggctgtgcatggaggatctgggggagaaatggggagcatgtactaatgggcacagagtttcttttgggattatgaaatgttctaaaatcaaatttggtgatagttatacactgtgaatatactaaaaatactgaattgtacactttagatgggtgcattgtatgggtacgtgaattatatctcagttatagatatctgaattatatctcaataaaacatgacataatataaaatatataatatttacatatcatatataataatgctatatatataatatacactgacacctggatccttctcttagagagtctgaattaattggtctgtggtatggcctgggcattggacttctggaaaccttcccagataattctattaaaaagctgatgtggagaatctttgacatgggtcttggtacttacaagtgtggtttgtgtgccagtggcaccaacgagacctgggaacttacaaggagggcaaaacctcagaccccacccaagatccactgaatcagaatctgcatttttgatgggatcctcaaataacttggatggacattcaagtttgagaaacattgtcagtaaggtagttgaatagtaaggcaggcgaatgttatctctgaagttccttatcctctgtccatccacccctcctcctcctgcctatggctttttattaaggatacccttcccagtagtgtcccatatcttccagtgtttcttgtccataaaaacataccaggcttagatcattttcttcgggggcactgctctctgctagggaaccactggccttttgggatatattctcctgagagcaaataggcagtggactagcacaactggttctatatagcaaatgaggcgacccaggaagaaagtgtagaaagaagagagtttaggtcctttcctgaaattccagcatttaaaagttgagttgaggaaaatgcagaagattgagaaagagtgactagagaggaagaatgaaaaccagaagagtatgggatccagaagacaaggggaaaaagggtttcaggaaggtgggagtggttagctgtgtgtgatactgctgttgagaggttgggaaggaagaaatgtgtactggattcagtgacctagagccacttcagttgagtggcagggaggagttgggatgggattggtgaaggagtgagggaagacaactctttcaaacatttgattgtgaagagttgaggagtgaagaaggcagtatacagccaggaagaggagtgagagagggctgttctatgctgttttattatgacttttctttgatttctttgattaggatattttgaacatgttcaagtatagacaggacaaaattcaagacataggaaagaaaacaggtaatgaataggtaaatttcctgaaaggcaggaggagatgggaaccagaaaagcagagttggctcctatgtgtcaagaaaagaagaacagaggatggatgtgtgtttgggtgggttcatatgtttcagttatcagaggtgaaggagcttggccacaaagttgagcacagactgagtatcccctatctccttatctgaaatgcttgggaccagtagtgtttcgggtttctgattttttttttgattttggaatatttgcattatacttactagtctaccatctctaatctgaaaatctaaagtctaaaatcctccaataagcatttcctttgagcaccatattggtgcttaaaaagttttggattttggagcatttcagattttggattttcagattagggatactcaaccagtaagtgctggattcaggcttccagctctcagagaagcctgagtgtctactatgtgccaggtcctgtgattgattaggtgcttgtaggggacatgaagaggagcagatataatctagatctagaaggagcttctaggctatagaggaggcaggcaagttgatagtcatttgcaatgcagcatgctgggcgtgctacattgctcatgtgtacaataaacatctggtgttacctacggtcatcatagaaaggttggcaagtagaggaggaaaagccaagtcttctggagaatttggggagcgggggaggttgcatcatttataaaattccttctggatagtctgatattctagtatgtccccaagtgagaaggcaataccaccagcctcactgctattgagaatcagtccattctccctccttttgatgattttatgtggcttccttttgaaggggaaaagaattggaacttaatatcaaactattttaaaatttcctttattagagtcttacgaaaacttatacaaacatgatactaagtagtatataagcatatttaggcatatatctcttaaagaataagaacaccacaataattatacaaacttaatattgattaaaattacagaccaataaggccaggcatagtggctcatgcctgagatcttagcactatgggaggctgaggcagacagatcacttgagctcaggagttcaagatcagcctgagcaacatggcgaaactctgtctctaccaaaaatacaaaatagcctggcatggtggtgcgcacctgtggtcccagctactcagaggctgaggtgagaagattgcttgaccccaggaggcagaggttgcagtgagctgagatcgtaccacttcactccagcctgggtgacagagtgagaaaccatctcaaaaaaaaaaattatatattatacacacacacacacacacacacacacacacacacacacacacatatatataaaataaaattacagaccaataaaatgtaagttaacattaatgtgatgagtgatgtttaactttgggtaaattgctttttccagttaggctctgagtttgatgtgttccaatgactaagtggtaattcagtgatcttgtcacctttctctgttggaatcactaaaaattttgacgtgttcagcattcactgggcccagattcttctcttctttttttcatttgcctgtgacaatgatagcacccctacgtggcaaagcagggtggcaccacagaccaagggttagcacggacactgggtggaaacaggaaatttcctgaggtggttccaggcatgcttttattaagagcattgaataaacataaaatggggaaaatcttgccatgaagaactcttgggttcccaagaatacacctttgcacgcagtttgaaaaatacagtgcgagctgggccttagggtgctatgagggcagacgggctgggtgtgctgccacactaggggatgaggcagggaaggcttctggaatgaaaagggatgagggacgagaactgtcaaaccaaggtctcttttaaactgtgcttatttatggcttgctgtttgatttggtgctttttcctttaatcatttggtgccaggttttcctatcagtcctttcatgtcctatatggttggccaacacctacaagggggaggttggtcacctaagtaatctcatattggtgaaaaagccaaggtatctgaaaggggttttgtaagaaaaattttaggatcggactataccaggaaacagcttcctgcctagctataggttgttaatttgtctgaatattttcaaaccaggatgcttttggtgtgttggataggcttttgagtagggagagatactatcttgaattgtgctaataatttaactcaacagcatctaacaaaggcagtcttattcttggatcatgtgtacagatcatagtctgaagtggaataagcagaatgttgttctcagtgtgagatgttatttagaacacactggaaacattgtgatgtcattgtgcactgaggcagggaaatgttagtctacattttatggaatatgtacttcagtgtttgcattgtacctggagtgataaaaagcaaaacaggtactcaagacctgtctgggctttggcctttgggcacattccccctcatcaccttccttcccacttggctgagctatggatgagaaaacctaggtcaatagttcaccaactcaccttcaagccaggtgggctgacaagtcctcctttgaccacaggaccccagcgcctgcatccagaagcatctaagatcctggaagtcaacttaaattttcaatgaatgggccagttgcagtggctcacacctgtaatcccagcactttgggaagctgaggcgacaggattctttgagcccaggagtttgagaccagcctgcttgggcaacatagacccaatttcaatcaatcaatcaatagtcgagtgtagtggcaggcatctgtagcctcagctactgaggagctgaggtgggaggatcactgaacccaggagtttgaggtttgcaatgagccataattgtgccactgcaccctgggcaacagagcaagacccagtctcaaaaaaaaaaaaaaatcaactaatggcactcattacctccttcctctcaacagtacctattctcttacctattcacctcaccctcatgaagcttttctaaggttcctatttgtctgtggactttcatttctgcatgcctgcctattcagaaacatctattccattctccaattatactttacgtttgcatacctcttttcacttttcaaagtgaatgggggactctccattttccctgagagcagcttagacaggtgatattgtcccattttataaatgagagcactgtagctagagaggttaatgactggctcaagatgtagaggagactttagagcttgtgcttcaacctacatggctggaatccagtttcattggctatagattataatgctttattttttcttagaaaaaaaaactttaggtagggcataatttagtgatagagaatgaggaactatatagtacgtttttaaaaatatacatatattccctgcccactcctgtgatttgttcttgggtaggtacatagtagctttgtcttaacactgtgaccctttttgccatgtccatcataataggtgagaacaccttatatgaagaatgcctgtgactttggtacatcggaatctgatacccttgaaaggggtctaggagacacctgtttctgagtagattccattgcatacaattcatagactctcagagttggaagagacaatatgagtcgtctggttcaccaggtgtttggttacatttttggttagatcccatatgaatccttaaaggttgtggagtgagtttgacgaacaatccttattattttgcatgacccttcatggcctaaaaataattctgtgttttaccaaactaagtaaaatgttgactatacaaaagaaaaaggtttttttcccttgggtcatttgggttttgagatgttctatttgaaacattttccttacaatttgttacctgttaagaaaattgcttatttaaatatctgttgaatgctacttaataaatgtaactttcaaaatgtgactaaatggtggtagttttctttgttaatagtgattattttattttgccattgttgcattgctataatttgttttcattttctttgtttctctctttataagctagatgccagttttcccccctagaattgttaaccatttacctgtgttttgtatgacatgcacatgggattcatgtgaacgttttcacttattttgcactttttagccagagatacagaagaagagagggacactcgagattaaatgttttagtgaaagttaatgggcagcatataacaagcctggggtacttgaaaattcagtaaaaagcaataactagggctggttgttttccctctttgcctttgaatagaaatgcatgcccacactgatggaatgtcaagtgcctgtgctgtaggactacttagcaacctgcccttacaaatctctatcttgaaccagtgtttcttagcattaaaaacaaagggtatgtgtacttaaaccctggagtcagtgtacagaggtctaacttctcacccaaaatcgtgggtcatataatattgtggccaggagagtgcttataggaagtttcaaaattcatttagttgatatattgtggtttgtagtgtacctaggaacattacattattagtaagaggcacatccattataagctcttgggaaggtgtatatttcaacttaacacatttgcagttatatttgaaatgaatgtgtttgcctataaggactcacttagtatctttagttcctatttaatgctaaacttattctgtagacccaaatatttctaagagccttgcatagaggcacctgggatattctgttacaaatatctgttctgtctacacagcttctccaccttaagtggtttaactggtgctttgcagggagtggagaaaggatatctcagaaggtcaaaggattaacattttcccacaaagtctttgatggaaagtctaagaccaggagaagaggagtaataacatgacctattattctgtaatttgcaaattcatgaagggcttccatatataaatttcacgtgtatgtgtgtatgtgtgggtgtgtgtgtgtgtgtgttaaaacctgtgaggtaactataacaggtattattgtccctactttttaaattaaggaaagcaagtctaggtcataggctaagtcattttcccattgtcacctagtaaagtggaccctccacccaggtgttaggatctgaagttctttgcattgttcactttgttttcctcaaacaccttccccttgagcctggagactatatctttcagtctttttacttaaatttctttaagtggctgctgggggtcagtgggaagatcaaggcagtaacaatggaacaggtgtggctgatggaaggctgagatgtcctcagcagcagaacaggatggacaggctttcacactgtttattcatttgtcccctggcaaaacactccttttggtgagccgccttgactgttcccctgggtgttcgcctgcccattgacattcttccccatatttccttgctgctgctctcttctatgtcccactgctgctgctgctggataccatgtttggcacagtaaatcctagagcaagtgatttttcacccttctgttgaacaaggaagtcagggttaaaacacagtaattatatggcggtcaagtgcaagagaggagtgactgcagaggatccctgttcccagataccttttattcctgaatttatactaaatcatgagcatttgtgcatgtcttttaaatatcatttgaagactcttttcatgattctgcacattctatcgcataaatttagcaacatttatttcagtgttctattttgggtatttaggttattttctagtttttgctgtgatgaatattatagaaaaaattaactccttggagaaaaaaactgttaactatttgaagagatacaagtctggtttaaatggtttgccctagtcattgattcatcagtacattgtaagttatttataaccagataaatacatgattagttttctgaagtaatataatagtgatactagttttattttcaggtggaaaaaatgagtaaagatggtcaataacagggatagatttcacaattacatcatcaatattctgaccctagaattttacttttggctcatgcttttataaaaagttggtgcaacagcaatatttttaatgcagtaagttgatacataaatgtataaatctgaaaaatctaaacccagttgtaaataatcaccactttgtaagagtcgttgcttcagtggctggcttaagtatttttggtggaatgtactcctcaacatttgaacttgacttttttttggtcatgcatgtagaaaaggtttaccgattatgagcaaattagtagaagttgaagaaccaattacttagaggtttatttcctggaactactgccttcaatttcttgtgcagttgcatagagaggaatagggtgaggcattacaggtttccataaagctatcagtccctctcttaacttttcagtcagactcacatcttcacccactgtccaacatccagacacaacaggcagtgagcagaccaactttgttcctggtgttctccctcttctctctgggtttcttttttcttttcagtttcttctctgggcttctttttttctattcagtttcttctctggttttcttttttctattcagtttcttctgtgggtttctttttctattcaatttcttctctgagtttcttttttctattcaatgtcttctctgggtttcattttttctattcaatgtcttctctgggtttcattttttctattcaatttcttctctgggtttcttttttctattcaatttcttctctgggtttatttttttctatttaatttcttctttccccaggggaccagtgccttttttcctactccaacctccttaacatggcatccaccaaggcccatatttttgaggtctcattgtctttgggataatgtctttgggacaatgtgtctcttgtctttgggaagcaagttatctttgctgtccccagtcagcaggaagtcacctgactttcccaaatttgacattatcttttccaggtatgtttgcttttaagcgtggtcctagaaatgtcactgccttaagcttactttgattgtgtggctagctcagtgcaagggtcacagcgttctgttctagttttgggtaaactttgatggagaggaccactaggtaaaaatggaattaggaactcatatttttttttttaaaggagggggcctttagggttagaaaatagtgttttttcttttcctgatctatggtggctgaaatgtgtgagcatagggaaatctgacttgaataaactcttaagatgaagtcatacataattaattgcctgtctctgcattctttccaaagtgatggctcttagtattcacacttgtgataacttatgtttcttgagtacaagagcctcaggacagccaattaaggaagaagacacagtggtggttctgttatgtaacctttctgctactgtaatggaatgggcaattgtcttttttttcttaacttccagtgcctgaaacagtacatgcagctggcaatccgagaaggatgtgggtctcccatcacttgccctgacatggtgtgcctaaaccacgggaccctgcaggaagctgaggtatgaatgactaccatcatcttcccctctttcctatttatgttatttattaggatcttgagtctttatgtatttccctaccagggagtctagcaagaaaatacagaggttaactttttaaaggagcactttattgcagcttacctttggactttttatacaaactgttaaagctgtcatttatctcagttctatttacatataccatcttgagtgttgaagaagctatagaataggcaaagtaccagaaatcaaatttaccaaatgtgaagttaggaggctgatatgatttggctctgtgtccccacccaaatctcaccttgaattgtaataatccccacgtgtcaagggtgggaccaggtggagataattgaatcatgggggcggttcccccatgctgttctcgtgatagtgcgttctcctgagaactgatggttttataaggggcttccctgccctttgctcagcactactccttgctgcggccatgtgaagaaagatgtgtttgctttctcttctaccatgattgtaagttttctgagaccttcccaggtctgcagacctgtgagtcaattaaatacccagtcttgggtatttcttcatagcagtgtgagaatggacacatacagaggctgaatagtgaatggtcttgtaaattgtaataccctaaagataaatagaccatggattagctgcagttatggaaaatataaactattgtgattccacaatgatagcctgagttgaaccatttccaaagagtagagacctttcaattgatctgtagcaggcatctgaaatctttttctttttttttcatatcccctcgtttgttcaatcaccggttattggtttgcctttaaatcttcagactctgctcactttaaattagaatataatgaactcttgtttattcttagggtgtttgtaagcctctgaacgacatcccaagaaacagatgaaatcagttgttcatttagcaaacacagaacacctgctttgcaccaggcaccaccaccccccagttgttttcattgccagtatactacctaatcctctcaacagacctcatgaaattgggtgttgctttcagatagggaaactgaggcccagaaggtttaagtaacttacccaaaaccacatatctagaaagtagaagagataggattctaatccattgctttctgactgccataattacgtggctttgagtagaattaggttggccaggtgctgtggctcacacctgtaatcctggcactttgggaggccaaggcagaaggattgcttgagttcaggagtttgagaccagcctgggcaatatagcaagacccccatatctacaaaaataaaaattagaaaattagccaggcatagtggtgcatgcctatagtcccagctactctggaggctgaggtgagaggattgcttgagccctgaaggtcaaggctccagtaagccttgatcacatcactgcactccagcctgggcaatagagtgagatttcatctcttaaaaaaaatgggaatgggggcatagaactaggtaggtagatagaatgtatgataaaggacttaataattggaagctcaatttgtgtgtgtgtgcagacacacatgtagatgtgtgtgtgtgtatagatatatatactgtacatgctttgtttatgaatatatattcttttacatatatatcctttgctttgtaagtgaagcagtcagaaagttagtatagacagtttttaacaatttgtgtctgggcatcctgtgttcaatttattgattagtggctgagtgctacaagtgagatataacgttttttagggaagtataaaaggaatatctgtttagaagtgatttaagaaaatcatggaataacttttttggtaaaaaggtaatatcgagtatgtaaaccctgtggagagatatattattgacttttgtagggtaaaaagagctatagtggagagaaattggactagttactaagaatattgttgatctgtgtcacttcagaattgtttttaaaatgagtcttgggtatttgggtgtatctttctatgcataatccttccaggaaagacacttcctttttgacttgcttctcaggtgtctgatgggtcagcaagtcttaataaagaccacagtgtgtgcctggccccattccaggctgggctggagaggagaataagaaaggcccgctagtgctcttcttatggagcttctggtccagcagagagacagtcaacttataacgagtcagataattataaaagtgaaatgcaagaagtggggcaggcaacaggagctgtgtctgctatgaaatcttagtgaattcatgcacataaaatctattaaacataagtgaatagcttggtgaaatttcaaaaaaagtccatgacatttatcggattcctgtattctagacctgtgctgactaatccagtagccactagccacatgtggctatttaaacctagactgatttaaatgaaattaaaaatttagttcaatcatgctagtcagtaattgctgagtgttcagcagtcacatgtggctaatggttaccagaccggacagcacagaataaaatacttccatcagtgcagaaagttcaaatgcatagtgttttagaattttcagtaaatggtagccactaggcactgacattttgagtatctaatgtaaggggccagtgtgcccaggtaagtggatcaggacaggctatagtgtctgtcttgcagttctctagagcagagcttaagtagtcttctcattttctttttttcttgcttcttgctttctctctctctctctctctcttttttaaaacctggttttcctctgttgcccatgctggagtacagtggtacaatcacagctcaacttcccaggctcaagcgatcctcccacctcagcctcccaagtagctgggactacagatgtgcaccaccatgcctggctaatttttaatttttttttttttttaaagagagggtctctctatgttttccagcctgggctcaagcaatcctactgcctcagcctcccaaagttctgggattacaggtgtgaaccaccacatctggcttcattttctttgaatagacattttctctttgtatttcccccctcctttgttctccttatcctttccccactctatcccttctctgtccttctggttctctttatccagttttactataaaagcattttacttttgtgcattaaaaccagacaaacccataatgagtcttaaaaattacaaaaggaggccaggtgcagtggctcacgcctgtaatcccagcactttgggaggctgaggtgggcggatcatgaggtcaggagatcgagaccatccgggctaacacagtgaaacccctttctactaaaaagacaaaaaaattagccaggcatagtggtgggcacctgtaatcccagcagggcttacacagcctaacccaggaggtggaggttgcagagagctgagattgcactactgcactccagcctgggtgacacagcgagactccatctcaaaaaaaaataaaaaataaaaaaaaaagaatcaaatgttctctatcaacttgctactgtctttttcagtgataaaaatacgtggtagtggtaattgataatcattttgagttgaaaatggaatagaagattatattggagatatgggtagctgcatcagtttacataggcctcctcctttgaaagtaaataccacacacatgaattggactgtaccaccttcatttctaacttgctttagatcaagattttattgcatacagttataacatgtggcttataatctatatattactgagtataccacaatggggttcattcacatatgcttgactaggttctatctcaatgactactacttccttctgccttttaaaaaatgcttaattacacaggtaacacataaatatactttgcttgttaaaaataattctgattaagcctggttctctttgtcttgctgctatttatattacaacacgtgattcttcattcttctctgtcttaccaaatgcatttaagtctaacatttcttcatcttcaaaggatggcaggaatgtaagctctttcctctgagtgcttccttgtgcaggtctagcttacagagttggctgtgctccatgtacctgccttcttgatttttccaaattggctcagctgtgattatgcctcctaaattttatctatgaagagtagcctccttagtgacgcacttaatgcccagttcaagtacaattgaacctcagtgtccatgggttctgcatttggggattcaactgcccatggagaatactcagaaaaaatatttttactgaacacgtgcagactttccttgtcattattccctaaacaatatagtataatgagttacctagcatttgcattgtattaggtattataagtaatctaaaaatgatttgaactatacaggagagaggatgtgcataagttatattttagtactaccccattttatatcagagacttaagcatctgaagattttggtatctgcgggaggtcctggaaccagtgcccttcagatactgagggatgactctactgttcccttgtataggaaatggtagaaaacggcagcttccctttcagtgtcatggaagctggtgagagacagtgactcaggaggacttgtggctagaggtgaacacactaggagccagggaaaagtaaaactttcctctattgcatcatctggtacttttagcttttgctctgcagagcttttccaatgtacttgatcttgtaatcatgtccaacatgaaattatgagaggcaggacacagattgtttattccaatagcattacttcaggcgaagcccttgcttgaagttagtagccctgttaaaaaaggtgatgtctaatttaagcagttcccatgtagtgttattgaagtagcatccatcacttcctgggaaagtttgaaccatttgtctggcctgtgcgaattttgagtggtgagtgcatattcctatttgaatagtacctgccattacatggcctgagagttttaacttcttccaattgctaggtgtcagtggagggcagggaagagcttctcactcactaatcttctttctaagccctggagcactgaaatgaccagcctgccttttactgctagtgccgcagtgtgcaccagagaaagggtgggtgcagctgaatggaggcttcagaatttctgtaagaagggagttagggcagggcattctggagacctggggtggaggtatggtggaggagggatcgagtactggggaatttgaagctatgtttgcaaaataaatacagtttttactcagattgcatatttagttgggtggctttgggaaagttggctacagtgatagggaatccaggtgttcttcccaaatcctctgcctccacttgccatctcttaacattcttccttcccattatcatggtgggaagctagggcaaaggaagggtgagaatgcccaggcaagaggccatattcctgttactgtggtgtaaggatctgaatgggaagggatgagtgtgtctgtaataacctttggctgcaatacgtgttggctggagaaaagtaaacctttgagatggtggggttagaggaatccgccaagccagagttaatagatatttttgagtttcctggctgaatcacattttagaaagtagttaaaactttgttttaaaatgtacttaaaactgtataagtgggtaataaggtttctaagaaaattctttaactaatggcacatagaaaactaagccacagtgagttgaatgtgtcacatgagtgtatggatatgtccctttttacttatgactgagtggagggagaaaagacgggatgatatatggaaagatgatcttggttagataatgtacagagacttctatagcacatgtgaaacaaagaccagtgaaagctgccctctacagtggactgcgaagatcagtggccctggaattccatttcttgccttctgcctctcagacagtgatgcccacatatggtttccaatcaggatttttaatctagtattcaggtgagagacttcagcttgttagtttcactcaggtgaatgggtgaatgtgctgtttttctcctctgttaggaagagcagctctcgttctctgcgttgtgaaaacatttttagttcctatgttaatgtgattagacattgatccgcacagtgagtgttatttcccctgccctggattttgcaagtcatagcatcccccaaattgcccaaaccttgacaggttgtaatgatccacttactagtggtcaattccatctccagatgttctgatatgttttattatttgttcagcctgtttaatttttaaagcaactgtagcagaagcatgatttgaaggaccaaacctaagtaaagtctgggcgctttttccttctgtttgggctttccggactctgatgggtagcagttctctaaagcctatccccaatttctgtttcatttttttaattgagtctttttttcttaactaaaaagcaatatacattgtatttattaacacttcatatgggaacacacaccacttttggcataaatacttttgtggtgagcaggcttcactttctgcctcccttttttgctttgtttttttctgagagggggtaaggtcagtgttagtgtagatggtgatgcttgtttaaatattatgatcgtggttaatactgattaacaggtgtgcctcacttttcatttcttcttggttgtggacgttagagagattaaatcacagttgtgtgtaacagttacagcactcccgtgtgtaggtgtggtctggcttccctggatatgctctgctagggatgaaatggaaaagcaaagacattcagctgagtaggaactgagtgtttttgttttgtttgtttgtttttttagacagagtcttgctctgtcgcccaggctggaatgcagtggtgcgatctcggctcactgcaagctccgcctcccaggttcatgccattctgctgcctcagcctcctgagtagctgggactacaggcgcctgctaccacgcccagctaattttttgtatttttagtagagatggggtttcaccttgttagccaggatggtctcaatctcctgacctcgtgatccacctgcctcggcctcccaaagtgctaggattacaggcgtaagccaccttgcctggccagaattgagtatttaataaggatcataaggttcatttttatcagaaatgaaacaaaacaaaatagtgattgtggacaattagtagcttttgttgtcattattctgatattattgctcttattctattaacatgaaactgaatttattttatctttgaattaaagtttgggtgttttcccccacctttggaaagagtttctagaatgatcatgaggaccaaaagttgtcttttgtgcttggataggagagagaaatttctgtttaacaataaataaattagcacagctttcaaagaagaagtagcaaaaattaactttaaattaaagaccattaagtagttgatctcagggtagtggtctcttgatagctgagaatatacctagggagctttgcttttactgctcgaatatggatttggttagtaatgaattagaagccactgaataaaataaatgtctgcagtctatgctgactgaaatttaaaaaatgaataaatagagaagggacagctttttcttacagtggaattttaatcaccaagtacaaaatgaatgatagaaatagaaaaatcactaagcaaatattacagtaataattatttttggcaagaattgtcagtggatacaaaaattagtgggcaaagtttgattagaaacaggattttgcgtagtttcagaatatctccctacaaggtaattgttaattccaaatgatagagaagctggcagataccaccttaaccacattaaaaagttaacatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacccaggaaagggaacatcacacaccagggactgttgtggggttgggggaggggggagggatagcattaggagatatacctaatgctaaatgacgagttaatggatgcagcacaccaacatggcacatgtatacatatgtaacaaacctgcacgttgtgcacatgtaccctaaaacttaaagtataataataataataataaaacccacctcaaatcacacactaaaaaaaaaaaaagttaacatcatcaataatgagacatgttgtcctcatgtagctcctgatggccccaaggacacgtctgtgatattcttgccaaaaattcataacctgaatctaatcatgagaaagcatcagacaaatccaaattaggggaacactgtacaaataactggcctggactcttcaaactcatcaaagtcacaaaaggcaaagataaattgaagaactgtcccagattggaacgtcaaggagataccacagctaggtacaagttggttacctggattggatcttagactgaaaaaaagaccttagtggaacaattagtgagatttgaataaggcccgaagatgctttaattctattgtatcgaaatataaatgtcattatttcaatactatgattatcattaggggaagttggaatggcatttagcaactaaatttagaaagtgttattaggggaagttgggggaatggcatttggtaactctctatacaagttttgcaactttttatataatggtctggtgtgattttgaatgatttggaaattctcggttggcagaaagaagataaatgcataccacaagatacctcttcataatctcttttattctctaggattgtcaggtgtagcagtcaattttacagtacttgtgaatatcctcaaaaaattgattgtagcccttttacctgcagcctgatttagtcttctaataatcatcctaacacaagtattaatatttcaattttacagttgtaaaaatggaggtcttgagcaatagtgacttagctccaaatgacagtggaaccaggaatttaaccttttgtatcatttgttgttgtgttttttttttgtacagctctcatctaaagccaaaaatataatagaaatatttcagaaaattagttctaatctgcaaaatccaacagacaacatcaaggggtagatcttttgtaaatcttatgtttattgctttctaagtaatttcagcctcttgagtgtagcttctgtatgtcctgtctcattgtatgctaggcttccagaccaaagctttactcatggtaagctgtcaacaaatatttagaaaaaatgtgactgggtgcaactggctcatgtctgtaatcccagcactttgggaagccaagacaggaagatcactggaagctgggggtttgagagcagcctgggcaacatagcgagaccccatctttacagaaaattaagaaattagccagttatgatggtgcatgcctgtagtctcagctacttgagaggctgaggagggaggattgcttgagcccgggagtttaaggctacctgagctatgattgtaccactgcactccagcctgggttgacaaagtgagacctcatctcttaaaaaaacagtaatacaaaagatgcaagtctaaatgaggggaactagggaagagaatggtgcattctatgggtgtcttcattccaaaaggaccaaatagaatgagaagcaaagtaattaacttcttgtaatcacagctttcaattaaaaaattgatttaccttagtaagtcttcgttccatacaaacctttgacttaaatgagaaatccaaagtaccataaaagacaaaaaaattagaaatctatgacttccctgttggcagtagtatgtactccaatgaaatttatttttctaatttaaaattaaacatccatctctacagttgtttactttttactgcattaatttctgtcatttttcacattaacatttcatctgtatctaaaacatcttccgtttgccttgtcttccataaactgtatttgacatttatataaattgctcatcattgaaaaagaatcagaatttttaggggttgactttgaaggatttaaaaggaggtcatcagtccacaaactattttagatgagggtgagtggggtacaagactgtcttctggaatcaaagaaggtggtggttaaaaaaagattcatagaatattattgaggtctcttgggcccagatggtatcaccccccaagtcatgttggtccagaagctgacgtagcatttgtttgtcctccacccatgatgaattagcgacaaagtcaggaactgaactctggttcctaaatgcctcctatcacttcatttgcttgtaccttctgtctccaactctgaattttatttgagacatctttgtctttcaggaaagatgtctgggtagcattataacagatgaataaagttgactttcagtgtaataaaagtccaaccacactgttgaaagaactatggtaaaatacatataacatgatattgcgcataattttttttgtaaagattgctaaggagctttaaggtaccagatgaaaatgcaacattttctccccaactggagaaagaaaatttggataaaaatgtttttataattaaagttatgttttaccacactttacttggaatgaggaagaccaaacttgttttgtggtcctttatacattttagctaatttagattcatttgcgaaataaacaacttgagattatttataagggaaaggattagattttgaatgcattataaaaggtataatatttgttaaatacaattttagctgcatcattttcttactccagttttctcaaagcagatgtcctttccttagttgcaagaacgtcaatgtaggtgtgttttgtgccaaaaaaaggtgatagtttagagttggagttgtcagggctaaaactctgtcctgtatgaacttactggatgtctggaaggctaatatcaaatgtgatttgatttgatttatatatgatttatatatgagaaaatctttattttctcatatataaatctttaagttatgtcaatatatttacatttgacatcaatggaattaaaatgtttagaatgctggtttaagagcagttagcttttcctgcatctgcctttaaaaataactaatttgaaatgtcattcagttaagtgtgaattgttgttgtttactagtaaacctttggtttatgttgccatctgaaatggaaataggagtctagttgcaagaaatattttaggcatttcttttctaccagagtctgagatgtcaatgtcccataaccgagggctctaggaagtgactcttgtcagaagacatgatttttatattgtttaaaaggtactctttcctaggtgacaaatgacatttgcataattcctgagatgctgtctacctgactttagtttttcaggattccaaagctagaactttaatttcaaaaaattcttaaatgaagatatagagaaaggaagcatctttaatacaggaatatgaataattttagaagtccctgtaataaaattttgttgtctggtcttggtagccactgactgaaggtagaaggtgatcaatgagttttgtaactgctcccttcagcagtgattctcagctatggtggtggagtggggatgacttgaaaattgttgcatgtgttttactacatgaacagtgtggagaaaaagaggtttgcaaacaattggtgtagagaaagtataataagcaaagccagaaagagaaatcaaaaggctggtaactcagggcactatgatgactgaagtctcaaccttttatgtctctggtttcagattgcctgtttggtacctgtggaccagtttcaactttatcagaggttaaaatttgaaagaggtatgaactcttctttttttcctgatgatgaatgtggttttacatgtgtcatttttacactaacccacatggaagataaaggcagctatgggctgtcaacaaagcctcaagggtactctaaaaggagaatactgtaattgcaacataaaatttcaagcctctaagctaccaccagaaaaaaatgcagactagcaggaaacagaactttccttatgttgtttgttttgtatttttaatttggctcatgtaagaaaggttttgcaaaatttagatggctttataatcacaataatacaaaagaaagtgaccctcgaaatgggttttaccactaattttcgattcttgaagatcacttcgaaacattaccagcccaaacatttttactgctcctcagaatacataacacctgtttttttgatactacttttgtaatcatggtaataacagagtatggatatgtatcattcttgtgcaatttacaatgtattggactgattttctttctgactttgggcttggggtaacatatagcttttctatttagctataagaattatatttttacttcatttggcttttgacaggtcttttttaggagacctttccctcttgtcataccctaatctatttttgaggtaaatggactatttcttagtatctcagaagtaggaaaaaattgtttctcccagaagttattggactggtctagtctcattgagtatattaaacttgaatctagcctgaacataaagttttctgattgctaacttttaaatatgtattcataaagtctagaggtgagggtggggggaaaatgaatatttatttgtcatgtgccaataagtttggtcagtacaattatctttatctcatttaatttttacaactaccctgaaaaataattcttacaggaaaaaagaaaaaaaacgtacagagcatgaagaggggtagagtaggaatgcttgttggggatacataggttaatagcaaccttagatctagatctggcttggtcttataggagaataacactgactttgtttttgtggtgttttttttttttttaaaaatccagcagccaaaaccagatttatctcatgggtggattacttaactcataaggctgatatattaagctaaatataccaaaaaaaaaaatcttggattaggttatttgaattccaaatggtgggtacgtttttgctctatatccagatgtgaagtaggaaatagtttataatgttgaacatggaatcagaaccagggagtcagaaggatttttggtttaatggatgatgacataatctgatgcttctgttctgtgataagttaatgatgggggtagttaatattgactctctctaatccatccacatgggccgattagattgagcattataacaccagatatgatagctaaagataagagcatcaaccatctgccctgccattttcccactttatcccaacatcctccactataaaaatcaattataattagaacatggacattcccagtattcaccctgtggatgcctggctggtagcaagtaccatgatttgagtgcttttacctggagaaagcctacagagttaggttggattttcaggctgctgcttaaatggtgagatatgacatatcaaccacgtcagtcctactcagtcactggagctcagtctatttacagtattctcatgcctccatcagcacttctcctctcccatgactgcctgttacttccctggctaacttcactgccccatatgtcagcaacaggccttgttcctaattgtttacattttaggtaacatatctgttagctcaaatgtcttttttgtaattagaatattctaatattaccaggaattacaactttctgtgggttgtttctcactgatgaatataaagttttggtttattttaaaatcgtagctaagaccctgagtgcaattgcaggctccaccactggtaagctgtgtgaccatggcaaggtccttaatatttctgcatctcaacttcctcatctgtgaaatggggataacaagtatctctgtaccacagggttgtgatgaggattatgtgaattaatacttgtaaagcacttcctgtgagtgcttcctgtgtctcagtgttcaaaattttaacagttggcaataaaaataacttaaaagtagcacgttttaaattaaattattctcaatgttcttctcctgtacacttttttcccaaagaggtaatcataccgttcttcaggaaatatcatcatactgaagtagatattattgattgtcttgttgtcagtgggattagaacacttgaagttaattggcaacatccatcgttatgtggggcaaggtagatgtggaaaatcattggctaagatttccactctttccccagatagtggttggctttttgacttttcagtagtattcaaacctgcttgtaactggcttattctttcattagacgtgataatatattcagtctagctacaattaagttgggcaggcatctgagccagtctatcttttttaggtggtgatgcatatttctactttgctctgttacaaattgatgaaatagttttattcatacatggaatttatttttttctcacgagttctgggcagatgccccactgtggatcccatgcattaacaattcatgttgttattcttattttatagatgaagaaactgaaaacaggacagattgagacttgcctaggaccacatagactgtggctaaccttccttatctatacaaatgttaaaattctatacttttctttttgttattaaacatatacctaacataaaagttgccatttaaaccatttttagatgtgcaattcagtgacattaattacattcatacagttgtgcagccatcaccactgcttctaaagctctttcatgatcccaaattctgtagccattaaccaataagtccttattcctcctccctgaaacccctagtaacctctaatccactttctcttatttgcctagcctagatatttcatatgagtggaatcatacaatatctgtccttttgtgtttgtcttattttacttaatatatgtttttcaaagttccattcctgtagtagcaggtataagaatttcattttttaaggctgaataacctattgtatgtttttaacgtcattttgtttattcatctgttgatggacatttcagttgtttccaccttttggctactgtaagtaatgctgctgtgaacactggggtataatctgagtttctgctttcagtatttttgggtaaagtaactagaattgggattacgggatcatgtggtaattttacatttagtttttgaggaactgccaaattgtaaaaccctataatttaaatataaatttaatagacatcttactgtcataaagtattgcagtgtattaaatttagtggccttttgatttaacctcctcattttatgaaaaacgtaacaggcccagaggcaatttcctcttaagtgattttgtttttgttttgtttattttttttgagatggagtctcattctgttgcccaggctggattgcagtggcacgaactctgcccactgcaacttccgcctcctgggttcaagcgattctcctgcctcagcctcccgagtagatgggattacaggtgcctgccaccacacttggctaatttcatattttagtagagatggggtttcgacatgttggtcaggctggtctcgaagtcctaacctcaagtgatccacccacctcggcctcccaaagttctgggattacaggtgtgagctaccgtgcccggcctcttaggtgattttggaaggcaatttgtaatcgtgtaattcttcattaccatccgttataattattattggaaaatggacatttcaaataagagtaaatttaagttaatgaagtgctacataatggaatttacatgattgggatacactttatctaattctgtctaaactttatctaaattatgtaaaatagacttcttatctacctcaaactcgagaccttcatcagctaggtgactttgagactatgttgtgaatatatatttgatgtgaaaccatttataaggggactttggggtgcattaaatacccactaatactgtaaatgagttaaatgactaaccaactgaaagaaaatctcattggctggactgtgagacagaattgtagagattgctgctgctctggaaaaacgtagaatcagagtagatgcagtactatttcttagttataaaaaatcatccttagttttttccaattcttagtgcctgccaagttcttttagtctttagcttgttgttcagtgtgtgaattgtcctctgctttgtgttacgtatttgctcagcttgtcctttatgtctttaagtctgacggaaaatattttgaataggattgcacaaaaatcatcctcctgcttacacgaagcaaagaaatactatctgatattggttggttattctacccgctttccacccatctgtgactttttgtctggctgccactatgtttctggctttctctttctgcatcagctttccaatattaacaaggaaaagggaatgctaagtttggcatggattaatgatcactgctttactttccagtggttctcaaagtacatgcccgatgattaatgcaagaatttttcttgcctcttgtttccagagtctactttttcaaaatagtttttttttgaaaattgggttaagatgatccatcttgagttcttacgcacttttcctttttttgtgaccctgtttgactttctgtaactgcaagttgcttccgttccttgctaggttgatgtatctgttcttgaatatttatttatattaccatatagcagtttaagaactcttacagaagggttgtgtcatattgttctccttcatttaaaaaaaagtgaaataggaagttgtctttcttttgctgtctgttaatattactgacttcactcctgtattaagtatgtgcttatttatgtattgcgtgtctatcctatgccaggtgccattccaatgcttcttcaagctgtggttccatctttctttgaaagcccttttgttctcagcattctcctcaagcctcctttcatttcatgtcttcacatttatgatattactctagtttcaccttgctcttttatttgtccttggtgaaatgcttccaccccagcttttgtatctgatcataaaggttttattccatcagagctccctatgtagttatgtagtttcttttagtgtttttttccctctttgtagactgtgtgatgcttaagtactttattgtctgctcagtttgatttttttaacacctcccatctctcattagtctactgaaacagttttatttattacagctgatagttaactcaagtgcatggtgtttcccacaataataaaagttcgtttgatgtcttttttggcacaatggtggagaatggcagaaaaaccactcctgctaggacagagaatatacaacagaatcaaaagcaaactcagcatatgtaatgctgatggtgccagttgggaaaaccaagggttttaaattgagattttgaaatctgaaggcaatcattaaggtcagatgtggtctttaggtctcatggcagttttatttcccagaatgtttctgtttcccagtaatagtcagaatacagaagtagaaaatagttttaaatagcatttcttgcctcgcataatttacatgaacatgcagagtctcaagatcacatagctgtggggctttgcttcagtaatcaattctactttttgtaagtaaattgcagtttaagtctttgaatttgtctatctctgatgtaaatatgtcagagttaaccacttctaaatcatgtatagtaatataaaattttgaaggcactattatttaggggctgacttacagggccctggtttctcttttactagatttctgaactttttcccatctcaaagctacataatgttttcatcactgctgatgcagaagtaattagttgactaggcatcagttcactttcttccaacattggaatagaaatttgaagggagggcaaccggaccttaaacttctggataattgtgcattttgtatatctgtattataactgtgtttcctaggccaaaagccaggaggtagaattgaatttacaataaaaataataaaaggtgttgaaaaaaatatcctgtgactcctgtgggcactccactttgtctcaaattccttataggtcattagtgtgagaagagaatgagaagaacagctcttcatgtgatagcaatctgacttccagctggtgtctaccagtttgttccttttagcttgggttctgtgtagtcctgttagatgccagggctgctgatgtctgatgactctctgcattttttctatttctactaaacctggcctctaggccatgtgtataatctgttacatgaggtatataagacaaaactattctcttaatgggatactggaattataatacatttccttaaaaaacccagctcttttaccttccattggcttttccttgtatctgctcttctaggagctgagctgaagggcattgtgaagtgtaggtgccatgctgtgctcagatatcttttcagtggaatctggccagatttctatgtctggatccctgtttctccgggggaagcacttttacagaagtgcccttttgcaaatatctctctgggttgttattgctgttctctggaaacacctgaatgtagggctgaacaaaatagaacttggctacatatgctaccattatcttttttactatgggaaattgatgtactgatgctatgtcttatatttctgttatgtcactccatttagttacacaaatgcaacattctaggcatcttgctgggtcagtgattgtcagagaagggtgaatggatcttccagggatatttggtgatgtccaaagacatttttgatcgtcacgacttgggtaggaagctactggcagctagtgggtagacgccagggatgctgctcaacatctaatgcatcattcattaaagttttattggttctattttagggtgtgtgtgtgtgtgtgtgtgtgtgtgtgtgtgtctgtgtgtgtgttgtgtgtttgttggctcaacaaatatgtcaggacatctccatgacggtaaattatccaatccaaatgtcaatagtgctgctgttgagaaatcctttcccagctgatggggaatacagtgatcatcaggacaaaatccctgccctaaaggatcctgtgtatgtgcatgtgtgtatgtgggaggttagataataaataaataatattagatggtgggggtatatccttttatataaataagggtaaggggaaagagatagatgggggaggctattttggataggatttttgtggaagacctctttgatgaggttatatctgaaaaaggacttgatttgatgtgagcaagccatatggatacttacgggaagaacatcatttcaggcagaggtaaaggtacctacaaagcccctgaggcaagaacaagcctggtttctgtttgagaaacagcaaggaggcccttatgatggagctaagtgagcagaggggagagttataggaggtaatttgaaagtgttagtcaagggcctgatcccatagattatgaagatgaagtcttagtgggatgagaagccattggagggtttggatcaggggaatgtcgtgaaatgatttccattttagaagattactgtcgctgctgcagaagagtggatggtaatggaatgacatggcagcagggagatttattaggaggctgtggtagtgatccagtccaaaacagtacagtagattatatgttaaaagcagaagcattgaaaatgcccagatttggagtctgttttcaaggtggaactgtcaggatttcctggtagagatacatctggattatatgagtcaggatcagtagtataaactttggaatcgtcagcatagaggtcaggtttaaagctgtgacactgaatgagcgcatctaagaattaaacatagctaaagaagcagtttcaggactgagccctgggacactataggttttagaagaggtggatctggcaaaggagattgacaaaggatggccagaaatatgaatccagaaggtgggtgaagacagtgtttaaggaggagagtgtccactgggtccgaagctactgacagatgaggagagatatggtctgagagttgataacagaggtctttggtgatcttgacaagtgggttttagtggaatgacagagaagtgccagcttggagagggttcagggtactatgagaagaaaaatgggtgcagtgaatatattaactctttcaaggagtgttttttgttttgttttgttttgttttttcttgaaaggaacttatgatccagcagaaagggatgatacaggagagggaggggggaggtaattgcagaagccaaatccttgagagtgtgaggggaacggatttcagtgccagatggagggattggatttacttgggggtaggtttaggtcatctctatcaggaaagaaggtggagaggttacggacatggatgcaggcagcctagtagattggtctgcatgggttctcttctagttgcttgcttcctaggtgcaataagaaggagggtcagcagctgagagtgagaagagaaaaggggtaatgcagatttgaagcaaaaggaggagctttatgtaatatgaaagtatagcgaacctagcaatattgaacgtgaagtttacaagatacctcccaggttgcatccattcataaatcatccagcagatatttatagagcaccaactttgtgtaagtcactgtttttcaaagtatagaactgtgacccagaataataaatccattttattttgaaagccagcatgcacacacacacacacacacacacacacaccccacccccaagatagaaccagcaaaagtttcatgaaactaatgtgagatgcaccctactttcttttctaatctgtttcatttttatgctggtcacaacctattaaactgatacctcaatccccattgtttgaaaagcatcatgataaagaatatagatttgtttgtccctttcaaagagtttaaagtcacacattaaggttgaggattgggggaaatttcactaattcttgtgtagaacctgcttcatgtcaggcactgtgttaagtgtctcgtttacagtgtctattcaatcttgaacatctctattttatagggaagaaagaagtcttgtgttagatggtttctatagtgagtagaaccacactttctcctatgataaccctagctgggttcagtgaaaactaaagactacttccattctgggtttttctgcttttgtaaaattcacctactttattacatgtgagaatctcatttacatctgtattatttggataaaatgtggaaatctttcagatcaaaactatctgtagattggttgcttattcatagttctaacctataggtttaagtgcaatttttaaaaatgtgcagctgtcagtaactctcaaaagcaaggcttagaattggctcagtgtgatctggttctcacaaacgtaatcatctcaaaggctttatctctagcaatttttttctttaaaaattataaaggttttaacatttttatttcacaaaaatcaataatacatagacaagagataaatctaagaaatatacaaaagtaaagaattaaaatccctttatctaaagatcagttgaagtttgctttacccttaatatttttagctctattcatttgtattgcatgtatatttactaaaaacaaagagcttatcttatgtgttaatctatttaatgaatttttaaaaattgacagataaaattgtatgtatttactgtctacaacgtgttttgaagtatatatatatatatacattgtggatataactaaaattaacatatgcgttatctatcttatgtagtcattgtttttgtggtgaaaacattttacatctactttcttagcatttttcaagaatgtaatatattaagtatagtcacaatgttgtacaataatctctagcaattctaagttagtagttacccagttgaaagagcaataaatgtactttgagctcagaggtgcctactgtgaatcaaaaatagagaaagtagatggaaaaacaaattgtataagtattctttgtgctttcagacagagttaccaatttcccttttcttatccaaaaatgccatttatgaatttctataaatgatctgtgtgtagctgtttgactgtaagggataagtcagctgtcactgttccagttttggtttctcctctttttgtgctgtgcaaattctgcactttcccagacttgtctgtgctggatgcaggttttatattaatgtattgatatgtttacttccaattcattactttcatggcctgtgtttaatgaggtgttggtaaacagtctttggcgggatgaggggaacaactctgatttgtagtgcttgccagttttttttttttagatggagtcttgctctgtcacccaggctggagtgcagtggcaatatttcagcttactgcgatctccgcctcccgggttcaagtgattctcctgcctcagcctcccgagtagctgggattacacgtgtgtgccaccaggcctggctaattttgtattttttagtagagaaggtgttttcactatgttggccaggctggtctcgaactcctgacctcaggtgatccacccacctcggcctcccaaagtgctaggattacagttgtgagccaccacacccagctgagtttctaaggtgtaaatattaatacttccaccatggctaattttaagctaccaaggtaatgtcactgaacttggagttggaaagagacacaattggttctcatgagctggcaagatcccacttcgggatgtgaatgcccttgttcagtgttttctttaaggacagaatcttaattctaatatccagaaaaagtctgttctctcttctacagcttctaaatgctgcctgcaaagttgctacctcagggattttttaaaaaagatctgttgatatggtgctttatctctttgtaatctaatgtcattgtgttttgtctcagcatgtgtttcctgctttgttttatgattaggagggactagttttacccccctgtttttagagttgattaaaggggaaactacatttggatatttggataaaaaaatcataacaaactttccatatataactattaaatatttcttacctctaccccaagagatcctcatcaatatttgttgataatttcatttttgttatctcatgggatgcactgtcatttatttgcattgcttggtttcccttttctttttttgacattgtattcattttaaacatctatttccttttcatactgtgaagcttctgaggaggaaagcctctatttttcatctccatgtgcccagggtctctaacaagtacctgaaaccagtcatttgttgaataaacaatgaataatagacatgtgtctaattttcagtcttattgtcataagaggtcatatctggagaagttatttggaataatccaaatttaattgaagtcgaggcttacttacgatatgagttccgtaaataagtatgaaagaaacctagaagtaagacctggataccatccatggatgggagaaagaaagcagtattgatgataaaggagaagggaccatgagaagaaaagagagggcagggcctgacacatagaagacagagtgacgagaagtgtccagggtcagagatggatttggaaacatttgctgaatgtgactatagagggatgtcacttgtaatttttacagagcagtttattaatgtgtttagagcaaaagttcatttcagatacttaagaaggatttgagtggataggaatgagaaccagtgaatgtgaattgctcatccaaaactaagctgagataggaagtaaaataaaagttatgtatagagaatagaattctaaaagggatagttatttgttttaatgttaaaatttgtttttcattgttgcccttgtaagtgatacttcataaaggaggtttaatgtttaagtgctatatggaaagttccaagtcttgccaaatcgatgactttcgaaatttgagagccctaattgaggtgggtggagagctatggtctaatagaaatcataacatactttcaacaccaggactgatattggatgattttaatatgctgtgcacatctgttgatgagagtactagaagtgaattggaaaattccaatacaaggcaattcaagatggtattattagtatgtgcattataagtcaattgttggcatagaaatacatctatatgcttttgaaaaacccagaaattactgctctgaatcaataggtgggcatcccctcactgtttcaggtaagttggagcacacaaacagaatgagaaacagccttgcctaccgtcagagaggccatctccatgaaatgaatagacagcagcaattaacaagatgccgattctgtgctccttcccccaaattaaggcatgtgcacaatagaaggtagttcacttaagaatggataggttatgacttgaagaagaaagggaatttttaggggagaggaaaagcataggatgagaattgtgtatatggagaagaatatgaaacaaaggggaaatttgaatgtgtttcagtattataaaaaagtaaatgatttttctaggggacagcttagttccagaattgctttatctgtttgtacatatgcagatcaaagtagctttttaaaaccaattttaaaaaattataaaagtagtacttgaccttttttaaaaaaaaatttcaagtttagagatgaagtaaatctttgcctcctctcctagcccctgcctttactcaagagtaactgttatgtttttttaatattcttctgcaaatgttaaagtatatttctatatatacatatttttattttatttattttgagacagtgtttctctctgttacctaggctggagtgcagtggcatgatctcagctcactgtaccttctgcctcctgggctcaagcaatcctcccacctcagcctctcaagtagctgggactataagtgtgcaccaccatggctggctacttttttgttgttgttgtggagatgagatttcaccactgttggccaggctggtcttgaattcctgggctaatgtgataggccagccttggcccctcagagtgctgggattacaggagtgagccactgtgcctggcctatatatacatgtttttataaaaatgtttcatttatactctttctgtctgctttttttttttttttttttgagatggagtcgcactctgttgcccaggctggagtacagtggcacgatcttggttcactgcaacctccgcctcccaggttcaaatgattctcctgcctcagcctccctagtagctgggatcacaggcgcccaccaccacatctggctaatttttgtatttttagtagagatggggtttcaccatgttggccaggctgatctcgaactcctgcctcaggtgatccacccgcctcagcctcccaaagtgctgggactacaggcatgagctactgcacccagcctgctttttttttgtttgtttttttcttacacttaacattatatcttagaggtctttccaaattgttatattgatttattttttttaaaaaagctatgtggcgttcaactgtatgaatgtatattatttgctcacctacatagaaaccttatagacatggcatagcatgttaactttttacaaaggtgtatcaatttttattgtacacaatgttttctacaggatactgtatgtggatgcatttttaaatttctacttacatacacatttccatgtgcctcacatttagaatgataaaatcattggtttggaaaagactttaaaagtcatcttggacatgatgctttaatctcgttgataaaatatctaccacacaggaggaacagtccttgtttgaactgggtacttgcttgctattaccagaaatagccacatcagctaagatgctttcagctgcaaggaacagaatgcctgcctaaaagtgactttaacagcaagggcatttcagtacctcactcacaagtccagaggtaggctgtcatgggttttggttaatttattaggttggtaaaattgctgtttttgccatgtttttaatgaaaacacaaattattttttaccaacctaatagcatctctgaatcatttagctttccctcatagctgcaagattgttttgatgatccaagcatcataacctcacacagttgggttcaaaggcagaaaaacagaaaggcctttctttcctatgtatcaaggtggagatccagtcccagaagccccttagtggacctgcctttgcctctcattggctagaatcatgtcacatgtccaagacttagtttcatggaattgtgggaaagaatatctctagaatattcagattttatagtgataggtcttcataaggaaggttcaagggggttgggagagatgttgaatagacgctctacagagttggctagagtagtcaatttcctttttggatagagtcaaaatctgtctcttagttactccactaatgctcttagttaagctctgtaagccattcctaaggaataaggacttctaatgaaggaaatgtgtagaaagctgtaaagttttcctcctttttctttttctacactcctttgcatggacctttatgtgctgtcataatagtgaaaaatacggaagttcagtgttttctctggctcaaactctttccttgctttcaacggactgtgccatagctgcactgcgccatagctgcactgcttactaaggtcctttctttatagtaattcatcaaaacctataatttctcctttatttatttgtctgtgcttcccttttgtcaccccagatacctgaaataataagctggtagaaacaagtcggaacttctaccaagtagttttaattgattagagctatgagaacaaattgcatccttgtatctttttaaggtgatcactagggatgctataaattttaacagtaatatgtgttttaagtttccttttcccttatttttccttctttttcatcaaacttttaaaagatctctgatttagaagggaagcgaagtagatatttgatatgggagtctttcactctaagttacatactaaccttcatttctttgggcttagtatttgtgaagcggttgtaatagattggaagaaaatattaaatggtgtagaaataaaagaccaaggccttggatcctatgtgtgccactgtttccttgacttcttaaggttttagtgatcttggagggtccatctctgttggggtctgagcatctgtgaattatagaatttcctccttgtgattgcatttgtgtgaagggttcactgttctttgacccccaccctccagaattcctagataagaccatatatttaaggatgcaatttttgaatgaaaacttataacaagatagatccaattatttcatttctaggcgagacattagtggagacagtattttattggaacatttcagactttctccttgatattgaatgtgtaaaattattaactgtaaaaactaaattcctacttaatacctttattttctttttgcaccatcctttggatttgtttgcctcctgtgtgtacatttctaggaatcatgagccctaggacgtttaaaactagaatgttgtcaattcaaattttgcaaaatacctgagttcagagaaaaaaggggtactctacccctcaaataacatcattttttacatggtatgttcccttaaaggtcatagtatatggaaagaacatggggtctgctactgaataaaaaagagataccaagcaagatttgcaaacacttaaatagatggctgtcagttctccaactctatcttctttcctgtatgtcatatggaactagccaatgtgttatgactagctattataatggtctgtgaaagtctctctgccttttgtttctagaacatgtgggggttttttttgtttgttttttgtttttgttttttttgttttgttttttttgagacggagtcttgctctgttgcccaggctggagtgcagtggtgcgatctcagctcactgcaacctctgcctcccgggttcacgccattctcctgcctcagcctgccaagtagctgggactacaggcacccgccaccatgcccggctaattttttgtatttttagtagagatggtgtttcaccctgttagccaggatggtcttgatctcctaaccttgtgatccgcctacctcagcctcccaaagtgctgggattacaggcgtgagccacagtgcccggcccacatgtgggtctttcacacattgtccctaagttgcacattggtagggagcagaatatccaaactgacaggtaatccaacttcttggctaagccacaccagatactgtttaatccctaaactatttgattattttcttccttgttctttaatttcctgggaatgtggaagaaacctcactatctgtttctcagtgcctgaaaggacaaagtctttttggaaaaatatcttattaaaaatttgctttttatgtccaattctcttccaagatagtgcccaaataattgtagaagggatttgagatttttgcctattttacgtgctcaaaggtgggaaatattctaaaagtcttgtgaattttgtttacagagaacactttttatctgttcataaaggcaatggtaagctattctgttagtacctactttgagaaatgtggcagggcttagcgaccttgtaaatgataggtttggatccattatgaagactaatagtagaaatcctcacccttgttgtattatacttccataaatgtcagtttaaaaaagagggtaaatggggcaggtgtggtggctcatgcctgtaaaatcccagcactttgggaggccaaggtaggcagatcacctggggtcaggaattcgagatcagcctggccaacaaggtgaaacctgtctctactaaaaatacaaaaatgagccaggcgtgatggtgcgcacctgtagtcccagctactcgggaggctgaggcagaagaatcggttgaacccaggaggggaggttgcagtgagctgaaatcatgccactgtactccagcctgggcgacagagtgagactctggttccaaataaattaaataaataagagggcaaatgaaggtgagaaagactcaaacatgaatcgggcagaccatcacattttctttctttacactttagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccggtaagaaaggaaactttgtctttgggattattcactagttttcttagaaattcaacataccttacgtgtagaaggagttacgttgtgatggcgtttagagattggttattttcctgcagaacttccctgagaagtgtctcagaattggtaagttgccaacaaaaaagcatttctagttgtttgccccagaggaatcttccagatattgctggaattaaagtttgtatgagttttgctttctctttaggtagtgaggcaccgtggtctactggttctcagtaggaaatcatgacttgttcccgctctttgctcagatacagtatctgcctgtattggtatatatcattcttgttgcttgcaaaatgagaaaagaaattttcttacctgactaaattgccagctcatgatgtgtgacagtcatattagaaagaacacaacaatagaaacaacggtcctaaattctttcagcacgtagaaaggagggttctctcatgatattttatgctctgtaaaggttgagattttatcgtgataggaagcaattaaatctgtacctttttagtacagcgggtttttttttgttttgttttgtttttgagacagagtcttgctctgttgcctagactggagttcagtggcacgatctcggctcactgcaaccactgcctcctgggttcaagcgattctcctgcctcagcctcccgattagctgggattgcaggcacttgccaccacgcctggctaatttttctatttttagtagagatggggtttcaccatattggccaggctggtcttgaaatcctgacctcaagtgatccacccgcctaggcctcccaaagtgctaggattacagacataagccaccacacttgggcgatacagagggtttttatggcaacagcagtgcccagagtgagagacctctgtgtttcattcctgctttgcttgaggctatcgttgttctgcatcagcaagaacaaaatacgagtgttgtaatcccattggcttaatcacacagtgcacccagaatgtgtagaaccaggcttcatgaatagtaatgctacttggctacgatgctgtgcttgaatctcagaacaaacaaatggagaggaatagagaagctaatacacatggcaggcatgtgccctcttagccggattcaaaccactgttgcctacattttcgtggccatagcaggaagctccgtgggtatcacagggcaacgtaaagaactcagaggataggaggatttgcattctgacattgtcactcggtatctgtgtgtctcatagaagccactcagcctctgtgagtctgtttccctatctgaaaataagggaattaagatacaagttgagcatcccttatccaaaatacttgggataagaagtgtttcagatctcagtgttttcagattttgaaatattttcatgatatgtttattggttaagcatccttactctgaataccaggagtcagaaaggcttcaatgagcatttcctttgtcatgttggcactcaaaaagtttcagattttggagcattttggatttcaaattgtggactagggatgctcaacctgtaataactgtcttatgacaatatgaggttattgttcatacgaagtctgataatagatttgacaacactctgtgagttggatatctctgtgtgctgggtggtggttttgatgggcagtagctaaagtgttacatggtgctatcgctcactccaattcctgttgcttattttctgtgccccttggggctgtgagcctgtattggtctattcgtctgtttggagaaggtcttttgaaagtatttgacattattttaaagtgtttatatttgagaaccccttctccatttgtctaatgaacagaccattagatagattatatacgcccagtttggaccctgacctagtttctctgctgtgtagccaactccttgccattcttatttaggcaatgcatgcttagggaatgaaatattaatttgacaaaatagtgagttaaatcagtggtggaaactgtaattatataattcactgaaagccaaaataaataaagattccttcttgtatgagttatctgtacatctaataatgtttttgcccacaccctttcttttggaagtgaattaagcatggataactgtgagttcattatctaaccatcaggagccctgggaattcaactgatgaccatcagctgaatgccatttctcatccattttgtttctagagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggatgtaagttccacctaggtttgttgtatggtgtttcctatactgtatctgcaccacagctgatatcctacagattttcctttaaaatattggggcaatttttgtcctgcaaaaggaatttatttttcttaatgagacttactaagcctgatactttagatatctaaaaacatctttttgatgaccttacatatgccaccctggtgttaaaggcaagcttttgttttcagggcatttcttgctatttgcacattgtctctattatgtaaaggactattagtgtcttcattttatattgctgttgtaacgaattagcacatacttagtggcttaaaataccacaaacttattatcccacagttcttcactttggaagtctgacataggtcttgctggattaaaatcaaggtgtcagccgggctgcatttctttctggaggctttaggggagaatctgttttcttgccttggaggctgtccgctttccttggcttgtggcctcttcctccatcttcaaagccagcaacatcagatctctcactcccttctttcttagtcgttgctccctctgaccacagctgggaaaggttctctgcctgaaggaccaatgtgatgagattgggcccatcaggataatgtaggataatctcctttatctcaaggttcttaatttaatcacacttgcagaatccctcttgtcatatagggtaacacattcacagattctgggaattaggccatgatatctttgggaggtagttattctgcctaccactattagattttttcttcgttttgaatttaaagaaaaatggttcaaatcaatggtgtctcctaactctcttctctccctcatgctctcttgcatgctctcactcgctctctctctctcttgttcatgagcatgcagcagtatcgctactgttttgacagtgttcccttcccagatcaaggggcttggcttaattttttctcaccattcatgaatcaagtctcaaattgaggtgcagttttattcagccctgtgccaaggctaatggtaacttcagagttaaaaatgcgatgcaaagagttggtgagaaggtcttacttcacttctggtcttttaaagtttggggtaacataagttgtttatagataacactctgttttggcaatttggacctctaaaatatgtccatatcagcgtaagccctcagttaccattgagttgctattcttttctcagctctttgttttgattgcttgatttgctttaattcaacaagcgatttgtgtagtgctttagttcagacatgcttagtgagtgagtgtgcagttagcatgtaatgtcatcaagcaggccaccacctgcttgatgtttaatggaaaactagatatgttgtttaagatgacatgtatgaataagaataataacctccatcttagtgatttaagaagaggtataaactgaggagaagaaaatggacattttagactctagaagttcagcagctcagtttggaagaaatatcttctatttaaaaattgatttatcataggcccttgagttacaattatgtttgatatttaagacctagcatgcatctaagtgagtgatattctggatgaggattttactgattgtacattacacatgcattacaaatgaaaaacaatttttttttgttttccttcaggtttcaccagaatattaattgggttcatatccacaaggaggctgagcccatgaggttctctttaggaggccagagtgtaagggaacaaatatgtgcaccagatctccatcctttggttgaaatgtgtttgggggatggtgttgcaaaggacatgctgttctgtctcttgtgctgctctggttctggagatgaaatggtgcagatgttaaatggctgaatacacagacttcaaatattgaagcatctttttttctggtgactgttttctaagatctcattttcagttttagccaggggcattggattgttggtaatgatgtttttctctacgcaagtggagttctacatcagatggtggtgtggatctctgtttataggaaagtttgagatcatggggccaggagaggggtgattgtctaaaatccaggcctgagacggacaccaaacaggaattttgagtgttgttggagttgagcttgttcctgccttgattctcacccctgtagtttcagaggatgagttacgcttaattgtctgctttagaatcctattcctgtccatagccttagagacttgagctgttcagttatctctttcctctcctgtggtttcaatttccactctccactctctcaacatatccatgcattcggctgtgtcacatttaaacacgagtaaacatttttcttaaagcctacttcttttccttactacccctctatttatctttcctttagaagccaagcttcaaaaaagcctaatcacctcttgctactgacattacttaccttccaaatactgcaatgtgttcggattgccacgtagtcacaccccgactgtacctctttcccagattttgagtgatttcttattggcagaatccaatagtacttgtttttagcatacctagattctctgctgcatttaacatcttgaccacttccatttcagtgataccacctctgttggtttctcttctacctttctggtcatatcccagttccctttttagcctcttcctcgatccagtcttaaatgcctgtgttcagcagcctctttgcttctcagtttacccctcttcctagttaatctcagtctcttctatggtttcttctaccccatgtacaccgatgcccagttgagtcccctttctccatttgtctaatgaacagaccattagatagattatctacacttaatttggaccctgagctagtttctctgctgaggtccaagtttttttttttttcagtgtagatctttgtgatgaactgccttttgaacagccctgcttggatgtctcaaccatctctcaagttcaacgtgtccaaacttatcttcccaacaaactccatctctatgttgtcacttctctcaataaagcgactgccttcttttaacccaatcactttcccttctctgtgattgcttctccttgtttctctccagttactttcttaatatctgaggactgtaacttcctcttctccatccatcctcagtcactggcattttctctctcctggtttgccacaccagcctttcagctgccttgctcctggtcttcccattccattgtacctccgccagagctaccttgctaagataagtagtcaggtcattactactctttttttttctttttaaaaataattaattgagattcgtattgattatgatctgctttcactttggtgatttacaaaactaccaagataaagattacaggcttggaattcctagagggggtcactgatatcaccagagaaaaactttgccttccatttggtgatctgatgtggtctgtattcatttctcaatttaaaactgcatatttactgaaatcaatctttttatttttcagaatgacattttcctcagacattatgacaaagggccatgcaggaataaacttggccactcaagagcatcagtgatgtggaaccgaacacaggtaccctgaccttatagggagcgtgacataaaccaaaatcgtgatggcttaaagagcccacctcttcgcctttcctcattattccctcctgggaggtaccatcccagcctgggagcttctggggagtgttagggcagggctagggaaaagtaatggggtaaatacctaaagttaattcatgagcacagtctccttaaggacaagcggagaaacaggggcaccagagctgccaggcagtcaacagtgacgtgcagaatgcaggcagatgttctttcctcttgagaaacagtggaatgactttcctaaagccctttaaggcatattacctatcaaaggcagtgtattagtctgttctcacactgctaatgaagacatacctgagactaggttagttattaaggaaaggggtttaatggactgacaattccacatggctggggaggcctcacaatcatggcagaaggcaaaggaggagcaaagtcatgtcttaaatggtggcaggcaagagagcttgtgcaggggaactcccatttataaaaccatcagatctcatgaaacttatttactaccacaagaacggtatgggggaaaccacccccatgattcaattatctccacctggccctgtccttgacacgtggggattattacaattcaagatgagatttgggtggggacacagccaaaccatatcaggcagtgctctaaaaccctgtgagccccttctagggcttagatccctgtgtacatgccattgtgtgtttatgtggcaggttcaaaaggagtcatggtttatttttaatttttaatagtgttttatatttattaaaggcggtattcctttggagggagtcagtgctaatatcctagtaatcattaacatccctttgagctagttgaggaaattcaagtagagagagagcaccaataccaataattcatgactatactgagcttgcgacagcttgagttagcatttggatggtttccatccttgatttggtcctttgtatctctctggcttctctccaattcagatcattgctgggcactagctgaaaggtcccagaaatgtaactgttctgtgtgcctgagatgatgtcttgttcaggctgctataacaaatgaccatagactgggaggcttaaagaacagaaatttacttctcatagttctggaggctgagaagtctgaggttcaggtgacagcatggtcatatcttagcaagggctctcttcctggtttgaagatggccatttttttgctgtgtcttcacatggcatagagcctagagaaagaaagcaagctctctggcatctgttcttgtaagagcaccaatcccatcatgagggccctgccctcataaaccaactaacttctaaaggcctcgtctccaaataccgtcacatcggggatttagggtttcaacatatgagcttcagggggacacaaacatttggcccacagcagataacagtatagttggaataagtatacatattgaaagacttaattgctgaaatatgcttttctttgaaatttccaggtggtggggattctcgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactgccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcacacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcatgaatggatgcctttatgtgatatagagtcatgtgtgtatgtgtagctttaagggcaatttcagaaatgcattagatgaatgacattttataaagcgatcacaattgatatctacaggctattatgtctcatgttgattcatgatccaggaagttttatgtatttaaaaaattgctatcgtgttatatttttccaatttttggagaagaaaatagctgtttaggctctctagccacaataaatgtaagcaggaaatcaa

SEQ ID NO: 404 - DNA, 61524 bp, Homo sapiens
tttcatttccaaagcacttgcaagaatctgtttatttatccagtgacctcagtgtattggctcacatgtgttaacatattttaagaaataaatcactgtgcaaatttgaagtatttgaatagcactatcattatttgattatatttttatatattttattatatttatctgcatttggtttatatccacagggtttttagtcatagatacatctgtaatttatatgccaattacatatgataatgttatttgtacctccaattttttttctcatattggtgatccctaattccaggtgtggtagagctcacagatcatgcacaatcttctcactatgtgcaggccctttggtagcaaacacaaaagaaaatcaagagatataaagagatcatacaaaaggaattttgtatatcttctgtaaacagaaagacagattggaaatttgtaagcaaagttgcaatatggaaataggaaaaggcatttctgaataagggggatgtttattcaagaggttgtgttagatccttgtgtatgggcaatgagctatcagccaactacaattactaggttatgagttcttggatggaaaggaatatgcctactttgtctaacaatgctaaaaaacaggctatatgtacatgataagtgattagtgtctgttggtaataaccaaagggatggatacaatctaattatctatcgagaggggacaggtcaaataaattgatattttcaaacctttataataatgaggtatgtttacatgtgcttttagaaaatgatctccagaatatattattatatgaaaaaaagcaaagtttagtttatcccctttaaaatagtaaaaaagaaacataagaaatataagattttatatataatatttctagaagaattcaggatatctgtttatggtgaatgtcctaaggagtaggacagagttactggtgggaaggagaattgcttttcattgtatacctttttatcccttttgaatcttttaatttataagttcattaatttttcatttaaaatatttaaaaaatagtattacagaaagtaattctgtatcactatgcattcagctctttaacataccacatcccatttaatataaacaacaactcatcttatggatgaatacatgaaggctcagagaccacaagtgacttatataaggtcacatagctagacagtaaatagcatatttaatacttgacccaaatccttgggcttcctactcactgatgcttttcccacaactccacagaccaagtgcatatggatataaaaccacagtacatttcaacatagttcagtcaggtcaattcagtactcaagcatgctggttttgctacagatgacagatcaagcttaaaagtactacatgatatttttccacatggctcctgctccttctagtccttataattctttcctattggggcccaacttcttcatttacatggctcttatctctggcttccagcttatacattactttttccccatagctgtaattagcccctgaactcccatcatcttggatcttccatgctacattcatcgttcccttccaatatcttttattccttttttttaattgaactcttagcttctacctatttccatttctttttttccaggtactaagttatctctcccttattttatacaacttcctatcttcctacctactcccaaattaataaatcccaattaatcaatcaactcccaattaatcaattatctcccaattaatcaatctctgctaagagttccttacccttccactgagcatggctactttgatccttttaccccaaacataagtatttataatatttttatacctttgtatagtatccattttataattttaccatattctttaatagcgactcaactgcacttctctgatattaagaccatggataatataactcaagagtacgtttttttcataccaacaattccatggttggcagtgtccaagtggttaaaaacatgtctctaaaattaataaaacctgggtttgagtcctagttctgtcatttaataattgtgtgagtttgggaaattttctaaatcttatctgcttccctatttgtaaaatgaggagaggaatacttattttataggtttcccgtgataattgcgtggataatgcaagcaaagtgctgcagatgttagtggactcaatgtaagtagcaagtaaatacccctcgtcttagcctcactaccgcatcagctctccacaaaccttgcaaaacaaatcttttccttctccaagacccatcccacccacctctcagcctcaacactacctcaacacatcatctgtgttgaaaccaagaaaatttcatcatgccacttacactaagggattcataggaaaaataccaaatatgcatcctttggcacagaatattttgtgccttaccctttttggagtaaagctataaaatttcctctaagtcataaaactctagattttaatctcagacattttctttttggaaacaattaaagtctctttgtgctgcatcagaattcacaaaaaagctatccagtgtccatttacattaattatactggtgattgactatggctatgccagagaatgtattccaggctcaagttctactttttgatgactgttctcaggatcatcagacacctgtccgatgtagcagctggaatatttaagcatcacagtgcttttaaaatagcagacaattgctgtggctgcaagaaaaagaaaaataaattaattaaaataaaatagcagataagccaaaccacaaagacatattttaaaccagggggttttaacactgaacaccctgatttcaattttttcaatgctatctaaatagaagtatattataatccaagataatacaagcctatggctccaagcaaagtcagatggagaaaaaagtagatttggttaaagataaacgaaaagaaacatttcttcctcacctctacactttgattgtagttcctggaatcaaatcagaatggagctaggctccctacaagccccattggaatggataagggaaactgtgaaaaactctaagggaccaacaagtcttttgcactggaaggaatcttcagagattttcctgaccctagtctaactccagtccccttgttttaccaagcaggaaactgaggattagaaagataaactgaaagtcccaacatgaattctaaagattgtcaaaggaatcataatagtgagattcaaaataatataccttctatttctcacccagcgctaggtgatgaaggctgggtatacagtataattggtctaagtgagcattgtaacccattgggttaccaaatcaggaataagcatgtgacctagtatcaatcaaacaaatataagggaaatttctatggggatttctggaaggaattttgatccttaataaaaaaaagaaacagtgagaaggactatatcttcttctggttgtgaatgcataactttgaagatgcagttcctggagctatcatagttgtactgcaaacttgccttagacaaaccttagaaagaaaatcaaaccactgagggtggcagaagggaaagatacaaagagcaatggtcactgagagtactgttgaattgctgcacccaagtagaataattactaaatttactaaaaattattgaattgtgcactttcaatgggaaaaaactatggcatgcaaattatacctccagaaagtgtaaaaagcaaacatttgattaattattgaaatacctaaatcattcagtaaaggatttgatgtaaacaactggtctacccagtaccaaacaagatataaggatgcaaatatattcctttaggtggattaacagatgagttgttctgactgaaaaattattaagttaagtctaaagtgaataaaagaagagaaaaagggtactaaaatgtcaaaacaagaagcaatcattgacagctacattttaggaaatatattctaatatctgaggcagaacctcaactgggtttggacaaaaaagaagtatttggggtaaaacaaaaaagtgtttagcatattctgacagtggaaaaaaagtagggaagtgcgattgttaagggttaggttgagtgtttcagtttgtgctcagaaagggctatttatagttatttagatttcaaattaatattcagatatttttaaaggtaagatattcttaaacctttgaggtcaacatccaaatctttcacttaaaaaatctaatatttttgtataaaataagaataatcactttcagatgttcttttattgttgtttttaactgaacatgagttcaagtaactcatgttgaacagattacaatcatgtaaataattctgtttaaatacttaattacactttgccacattttaaattataaatttaatagatttgattttttgcaagcatttcaagtgtctgcacaggtacacctataccctaaaaagtaaggccttccacagctccttcatcacttctatagagctaataaattttatctatgaaaatatgaatcacgattgttcataaatattccgaaactgattttaataaattattcaaattcttatatttttcctcttaagtcacatatctaaaccaaatacatatttcaaatgaaagtgacatgtgtaatctcttagattaaataacacatacacatatttccctaatgattgtgtaaaatgttcttatataaaagcctaagtatcatgggtttcatttatttcattgcatccattttaattctaaaccttcctgagtttcaagagatttactcagtgaaggagatttaccatctcaagtattaatagaatgaagttattaaatcaaagttctaagatcttgatagttatttattgttcagaaatttaagactagagagtggaacttgaaatctatacttccatgattcttccagaatcacaaaatagattgcagctattttatacaaactgtgtcagcaagtctatgcagctcacaaaccaattttattcacctgactgggatagctagaattctgcatccttaccatgactgcaattaacttccttcatgctctgacttgattccattaatttccttactgtctgataggactctgcaaaatttttgcattcttttagtcctgattggattttgtatgcctctcatactttggtctgactctagacatactcataatccttttaatgacacacttgactttgcagtggatctggcccacagtgtcttctatcctttaacagagttctttttgtcaaggatcaggtgccaaagaagaaagtttgtgaggtcacgaaattgatgcccaggtcattactttcatgatggaaggtgatctatagtgttggaatggttagagtggaagccaagcagggaataagtgcaaggtggtcaagaaagactcactgggtgaagtaatactagtggcctgatagaggagtagagaagacggaagctataagaatgtggtcctacagggaaaatggctccatttactctctgggaaatttatgatgataaaatccagggttaatgccacgcccatatatggaaaatatgttgggaaagtgaacctgtgcaaaattagagagtgaaagatttcaaagtggagaagcctaaaatgtactaatgtagatgtaaaaggcattagggatggtggcaaaggtaaaatgaagaaagaaatttgatccaagagctccagccatctactaagagaaccccaagccaaaaaatccctattcaactaacattttggacagtccaaggatgtgtgagcaacaagccagctacctcttcattttaagccacatatggtatatcaaaaatttctactggtgacaagaactgaaataatacagtttcttcagagctggtagtgataattaaatttgatctgtggcaactttaaacatagtgtttttgaaaataaaggtttgaaaaagtgataaaaatgtgttattgtactacactgagctaatctcatctttatttaaaatcatactccaaggttggtctacattgccttctatattcttgcaaatgtttctgaattggacggcctgtgattcaaacagaaaaagtgaaatataagaagccagaaaacttattgctcataaatttccttaaaggaaagaagaggaagaaatgttggcactcagcttgtttccctaaatggtgaatggcttcatcatcccacccctaattcaagtgcttagaaatttagcagaacaattgacgacaaatttaacttgatctttgccagagatatgaaaattttagttacaaataggattgccatatttatcaaataaatattcaaaatactcagataaatttgaatttcagataagtaacaattttggtggaagtatttaaccaaatattgcaataatgcatgggacatccttatactaaaaatttatttattgtttatttgaaattcaaatttaactgaatatgctgaattttatctggcaacattatgttttcaagtgagtagagtttagtgacttgaaattaaaaagcaatgaaccagaggctgtatgacaaatatagctcataagggtaataactttacccaagactctaatttccttccattacctatcccgtgctcccatccctgtaatattttttaaattttcaaattttaagttttagtccaatttttacatagggatagtcaagtgagtagcaactttgaaaaccagcttgactctaacagaaaatcagttcttctcccagtcagaaggcattctagatttaaaagcttcatttatttatgtcaacatttttagctaataagaaaataagcacagtttatacatagttgttacaacctactaaatcagctaaaaccttgcctgtttaataactaatatacatgtcatataaatgaaaataagtaacagattactgacttcactttttttttattattatacttttaagttttacggtacatgtgcacaatgtgcaggttagttacacatgtatacaagtgccatgttggtgtgctgcacccattaactcgtcatttaacattaggtatatctcctaatgctatccctccccgctccccccaccccacaacaggccccggtgtgtgatgttccccttcctgtatccatgttttctcattgctcaattcccacctatgagtgagaacatgcggtgtttagttttttgtccttgccatagtttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatatgtgtgtatgtgtctttatagcagcatgatttataatcctttgggtatatacccagtaatgggattgctgggtcaaatggtatttctaattctagatccctgaggaatcgccacactgacttccacaatggttgaactagtttacaatcccaccaaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtgttttttggctgcaaaaatgtcttgttttgagaagtgtctattcatatccttcgcccactgtttgatggggttgtttttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttggtttaattagatcccatttgtcaattttggcttttgttgccattgcttttggtgttttagacatgaagtccttgcccatgcctatgtcctgaatggcattgcctaggttttcttctagggtttttatggtttcaggtctaacatttaagtctttaatccatcttgaattaatttttgtataacgtgtaaggaagggatccagtttcagctttctacatatggctagccagttttcccagcaccatttattaaatagggaatcgtttccctatttcttgtttttgtcaggtttgtcaaagatcagatggttgtagatatgcagcattatttctgagggctttgttctgttccattggtctatatctctgttttggtaccagtaccatgttgttttggttactgtagccttgtagtatagtttgactgacttcacattgttaactgaaattttaacaaaaagtgatcaatttgtcatatgttggtaataaaaagtcatcctcattaaatatcaaatgtatgagaataaatgaaattcctggagaaggaagtgaagagaagatagactatccacggtatcagtacagacagggagaggaaagaaagtaaaggtgagcaaatgaatgcctcccaaggtgtagtgggcagaataattacctccccaaaattgtccatggcctaatcctggaacctgtgaatatgttgccttatacggcaaaaggaattttcaagatctgaataaggccaggcacagtggctcacatctgtaatcccagaactttgggagggaaaagtgggaggactgcatgagcccaggagttcaagacttgcctggacaacaaaggaagaccctgactctccgtataaataaaatttaaataaataaataaaaatatgtgaataaatttaagaaatttgagacagggaaattatcctggattatccgggtgggcttaatctaatcacctgagtctttaaaagtggagaacctttcctggctttatagaaccagagagatagcagcataaggactagacccactgttactggctttgaagatggaggaaggggccatgaactgatatggttaggctttgcgttcccacccacatctcatcttgaattgtaatccccataatccccacatgtgaagggagagatcaggtggcactaattgaatcacgggtgtggtttcccccatgctgttctcatgatagtgagtgagttctcatgaaatctgatggttttataagtggctcttcctccttcgcttggcacttctccttcctgctgccttgtgaagaaggtaccttgcttcccctttgccttccacaatgattgcaagttttctgaggcttccccagccatgctgaactgtgggtcaattaaacctctttcctttataagttacccagtctcaggcagtactttatagcagtatgaaaatggattaatacatgaaccaaggaatataaacttctagaaactgagggaaaaaaatggattctcccctacaaaggaactagaaagttcctagaaaggaactcagtgctgccaacaccttgcttttagctcagtgagacctatgttctggcttctggcctgtagaaccaattataataaatttgtgctgttttaagccactgtttgtggtaatttgttaaagcagcaataaaaaccaatatgtaagacttgactgtttttaattaaaacacatacaattttagagtgcgcattttcccaggaaaggtctcagtgttgggatctctacaaggatataaaaggattttctcttgatacctccctgtgaatttgcacgctaactcccaccctgccccctcatcttcacccctgaaatttacagagtttctagggattgtcaagatgttggctactccatatgcaaaagaatgaagctggacccttatcttatacacaaaaatcaactcaaaatggattaaaggcctaagcatagacctgaaaccatgaaacttctagaataaaataggggaaaagctccttgatagtggccttggcaatgattttttggataggaaaagctcaggctacaaaagcaaaaataaacaagacaaactacatcaaactaaacaatcggcaagatgaaaagataacctacagagtgggagaaaatatctgcgaaccacatgtctgataagtggttaatatccaaaatatggccaggcgcggtggctcatgcctgtaatcccagcactttgggaggcggatgcaagcagatcacgaggtcaggagattgagaccatcctggctaacatggtgaaaccctgtctctactaaaaaatagaaaaaattagctgggcgtggtggcggatgcctgtagtcccagctagggaggctgaggcaggagaatggcgtgaacccaggaggcagagcttgcagtgagccaagttcgtgccactgcactccagcctgggtgacagagtgagattccatctcaaaaacaaaaccaaaaacaaaaccaaccaaccaaacaaaatatatatatatatatctccaaaatatatatgaaattcacacaatagccaaaaaaatctgaataacccaattttaaaatgggaaaaggacctgaataaacatttctccaaagactaaaaatgtccaacaggtgtatgaaaaggtgctcaacatcactaatcatcagggaaatacaaatcaaaaccataaggagatactacctcacagttgttaggatgggtatgtagtcctaactactcaggagctaaggtgaaaggatcatttgagcccaggatttgaggctgcagtgacctatgtatgatcactccagcctgggtgacagagtgagaccctgtctcaaaaaaaaaaaaaaaagaaggaaaagaaaatattaatgttctattgtagaacccttaaaaggaccttaaagatgaaccaattcaacttcactcatttactacataaatgcctttttcaaattcttcatgtgacagaaaaatgagttgagctaacaaaatgaaggcagaattgttaatctgataacagtagtatgaataattcaacagaagctaggaatttttgtactgatacattgactcatttacaaagctagaaggaacttttctgctgtttgtaaaatttttgtttagagaaaacccaccaagcaatagagtgaacatttagtaccttaatcttagatgatgaattcgttaaagaatttaatggcaggctattaaataatttgcattcactagcagaatacagcagtgtggtgacaaaaatctatcagacttaaaattaaatgtagtacatttgctaaaaagagtgatcatgtaatctaaaagcaagtctagaaattagctggttaacattacgtgtttttcaatgttttgaatttttctctttataaatggtttcagcatagtttttaaaaagaggtcccaattactagcgttcctatacaccaacaacagccaagccaagagccaaatcagaaaggcaatcccattcacaattgccacaaaaaaagaataaaatacctaggaatatagctaaccatggaggtgaaagatctctacaataagaattacaaaatactgctcaaataaatcacaggagacacaaacaaatggaaaaacatcccatcctcatggataggaagaatcaatataatcaaaatggctatactgccagaaacatttacagattcaatgctattcctatcaaactaccaatgacattcttcacagaactagaataaactattttaaaattcatatggaaccaaagaatagcctgaataaccaaggtaatactaaacaaaaagaacaaagctggagtcatcatgttacccgacttcaaactatactgcaaggctacagtgaccaaaacagcatggtactggtacaaaaacaggcacacaaaccaatggaacagaatagagagcccagaactaaggcagcacatctatgaccatctgatcttcacaaagctgacaaaaataagcaatggggaaaagatgccctattcaacaaatggttctgggaaaactggctagccatatgcagaagattggagctgaccctttccttagaccatatacaaaaattaactcaagatgaattaaaaacttaaatgtaaaacccaaaactataaaaaccctggaagacaacctaggcaataccatcctggacataggaacgagcaaagatttcatgacaaagataccaaaagcaatcacaacaaaaggaaaaattgacaagcaggatctaattaaacttgagtttctgtgcagcaaaagaagctatcaacagagtaaacagtcaatctacagaatgcgagaaaacatttgcaaactatgcacttgacaaaggtctaatatctagcatctataaggaacttaaacaaatttataagaggaaaacaaataaccacattgaaaagtaggcaaaggatatgaagagacacttctcaaaagaagacatacatgtggccaacaagcatataaaaaaaagctcaacatcactgatcattagagaaatgcaaatcaaaaccacaatgagataccatctcacaccagtcaaaatggctattactaaaatgtcaaatcaaaacaaaacaaaacaaaaaagatgctggcaagattatggagaaaagggaacacttatacactgttggtgggaatgtacattagctcaaccattgtggaaagcagtatggtgattcctcaaagagctaaaagcagaactaccatttggcccaacaatctcatcactgggtatatacccagaggaatataaatcattctaccataaagacacatgtacacgaatgttcactgcagcactattcacaatagcaaagatgtggaatcaacctaaatgcccatcaatgacagactggataaagaaaatgtggtatatatacaccatggaatgctatgcagccataaaaaagaacaagatcatgtcttttgtgggatcatggatagagctggaggctatcatccttagcaaactaatgcaggaaaagaaaaccaaataccacatgttctcacgtataagtgggatagaaatgataagaacttatgaacacaatgtaggaaacaacagacactggggtctacttgaggaggtaaggtgggaggagagagaggagcagaaaatataactattgggtactgagcttaatacctgggtgatgaaataatatgtataacaaacccccgtgacacgtgtttacctatgtaacaaacctttacatgtactcccaaacctaaaagttaaaaagaaaataaagttcccaaaactttatttctctctagcttcttctccaagagcaagtgattaaatcatgacaatgtttctaactatgaatgtcacacataaaatatgataccaattgaaagtatatagcttgcaagtacatctgggaattgtagaaacacagacagctcatcagtgttaattcaggcatggttttgaacaatgttctgtctacatattgggttttctgattacctaactttcctttcttgtctacatttctcaacagagatttttagtttatcttagagtattcatcatggctcaacttataatttcaagcgaagcatgattcagaatgccctcgatttttagcccttcacagcctttggttatctcaaagttacctgttctgatgtccacatcagtatgctaaagttaggagactatgatactatattccaaagattttcctcagaaaaatgaagacagctgttggctaatcagtctgaagtgcttgtcttttgcttataaatcaggtgctccttaagttatagttctttctttccttatctgtattcattcagcagctgatgaaactgtgctattatcttccaaataatctggcattttctctgcagaattgtaaaatcaatataaatcagctgagaattaaggaaagcggtaataaaaatcctgaggcaaagttaaaaaattttaagttttctgatgcatgattctgatttagattagttttcaggtaactgtttgagggtcaagaaagaatacataaactgatgatgatctgggtaaaatctgtgaaaaatagaaacttggtgttgatataaaaagatgttaactgtatttattatacaacataaacatcaacatgtatccgataatggaagaatgctctgtagctaaagccaatgaagagagaaatttggtagatgatagatagacagattgcactgattctacgagcccccaggattttgtattcccttgagatgtctcagtgcctggtcagcagctggtggagaaaggtcagagtgagctgcaccataaatcaatggtacagagaggcaggataagtggctgggcagaggcgggggagagagggacttaataggaataaaaagaggaataggttttgagatggccagttaatggttactgaaccggaaaaatagcactgcaggttgcagaaatggctaatgtcaaaactttgcattataatgagatctagctcaaccgtagaaggtttttacttctacagtttctaataatctgaataaagtttcttaaaatgccacatttattctccaaaagtttaagcattggtaaattcagagggcatactattagggtttgtaaaacaaacaaagaaaacccacaaaaatattattttagtaataaatttgcagacttgttcattatttaacttatgccatgtataactctgagttgtaacttctggctctatatctgaattctcatcaagtataaaataatcatactgaatccaaaaactcatttcagagaggtgtatggttacaattttttttaacatcaataaagatcctcttcaaattcccactaaaattaaaccataagtgctaccatttctagggtttatagtttttaaagcaaaaaacaaacaaacaaaaaagaagggatatttacctgagtataccaaataaacaaatatttttaaacatttgtttaaattgttaactttggcatattgtaatttagaggaaaatatcccgaaatcttttagcctaactctcctcatagtacagataagacagccatgcacattgcaaccctgggtgcccaaagtcacactacaaattaaggtcacaggcagaaaattgaatatacgtctcctacttcctggtccatcttcctttcttcaccagaaaaaaataattttaaaaatgtataaagactatcatggtaagatattagaagaatgcttcagcaatgatgttatgttttatccaagtcaatgttcagtatgagtagaatataatcaaaattagagagaagatagaagagtcaggaaacgtgctggtttggttatcatatcttcatagtgtgtgttcgtaaaacttaggaaaaaaccctgggattcagctgcccagatatatttaaagaaatatgattgttctacaagatttctttcaagtaataatagaaaaaaatagcatcagttttgctattgttgtaggagtagtagaattaacagaaattcatcaattgcctcatttttttttctagtgaaaggagatggccagcattcaagaatttgcagaggctactacaaggaagtgcagattcttctcacagttgtttcttttctcacgtccaggagaattcagcattgcttaagcatatttgccccagggtctagatgacaactgattggagtgatgtttgccctatgcttttcagacttgattaaaatgactagtggaatgaatgtgtgctgtggttgacagccttctaaatttgataaagaaaactataattatatccaatcttacctgatgttttaaacaaaatatttacagtgtgcaatgaagatatctttgtcctttatatgacctgtaagatggcttagaaattatagcttaactggatgcgttgatatgattaaatatatacttagttgactacctaagaattgcacaacaaaaatgaaaatgtaagcctgtgttttttttttgatcttccctaagaatcacttatgtctgaatgtgaatacaatttttaaagtaatgctcgttagaaacataaaaataagaaaagatactgtattttattttcacagaaaagtgcttctataattttaaataaatgcaatatgtaggggactcatccaactctgtatcagaaaggagactgaagaaactggaatacaaaatgcatctgtttatcctgttttcaaatatagtcaaaattgaggtcttttatgtagattttaatcatttttagtattttaaattcttccttaaatttatctttatagcccaaatctctcttgccatgatttggatccaattcccatttttcacctttaacagaggcaaatcagtgggtagtgtctaaaatacgtgataaccttcaattgaaaagtaaccatcagtttacaaatattttgtatttttaaggatggatctgcttctattaaaattaagaatgcaggtgaaggctcaggactgtcactctgtttacagactgaggtatggttagctctctctcatgcttctttatagtacccaatgataatcactaattactaataataactactttattatcatttcccactattcctttattgaatgaaatgcagatgggtggtgaggtgtggaggtaattaacactctcacatgaaagtccaaaggtagtcaaacatgactgccacttaaatcccattgtccagaagggaattacttggccatacccagctgcaaagaaggctaagaaacatagctttgatatggggcagccatgtacccagatggacaccgggactttgttaatacagactaagcggaaaatggatttgggggagctactagcagtttccattacactccactccacacattttaacattgtattaatagtcaaatccattgtgcctgggttaatctcatatggaccttcattgttttcaaacttctgaattatatttcatgcagagaaaaaagaaattggtgtcaaggacaatacagaagaaaaaaattctaagcatcaagttaccaagaatttataattagacatgctcatagtatattttagaagtgaagaaaagtatgacaaattgaactataggaaaatctcttaatttaactaagagcttggctctgatccttttgtcagtgacttgtgcaggatctcaaaatcatattaagtgtggcattaaagagatagggctcagtcacaaacttagctttgtttaggaattctaaacatggccagaccacttcaaagtgcttcacaaaagatgtacaattacttaaaaaactaatgcaatctgtggtcccaagataaggattgaaagcagaaggaaacaagtgagtcattacaactattggcttctatttttgatgagataaaggaattgcctgcttgagttctagctgcttcctatgtgaatatgcacaaagaatgtaggtgtggtaaataaaacagaagaagctattttaatacattttcataatattttgcatgtagttttagactgggttcatttgataaaatctgaccttcaaaataattacatagtaaatttttaaaattttaaacagacagttcttatttttgctaaaataagttcttgatttggtggccgccaaactcctatttgcattctatgtcatatgacttaaattatctataattaatctttcaatatttaaatattttctttttctttttggctaggactattgatcatataataattaacacttccaggctttggggctttgtatagcagttagggaaaaaatatatataaagatgaatcttttttcttccttcaaaattttgtgcctttctgatttactgtagcctggagcagaaggtcactgtctgatcctcaaacttctgattgttcacatcttcattttgctgctactgatagactcgccttcctggtctccgtacattttgacttaactctttgtgtcttttgtgagcatacacacataaacctggaggaatgttttaaaaagatgactaatagctgggcgcggtggctcatgcctgtaatcccagcactttgggaggctgagatgggtggatcacaaggtcaggagatcaagaccatcctggctaacacagcgaaaccccatctctactaaaaatacaaaaaattaactgggcgtggtggcgggcacctgtagtcccagctacttgggaggctgaggcaggaggatggcgtgaacccgggaggcggagcttgcagtgagccgagatcacaccactgcactccagcctgggcgacagagtgagactctgtccccaccacccaaaaaaataaaaaaataaaaaaagaagactaatagtcagaatggtaaacacatatctgggatttccaataaggatatcctgtgacaaatttaatttaagttcaaactaggaatctctaccagcacctagcaaatacattggacaatgagggttaatagacaggaatgacaagtgctatactgctgaattttatgctcagtgttcaccactttttctttaatggtaataacaatatcaatagctaacattttttgagcatttactaatgtatggacactgttacacatatcttatccatttgctaattaaatcctcttaacaatctacaaggcaggaatcattttcttcccaattttactaataaggtagctgcatcacaaagagctcaagaatttgcccaacatcacataatcaggatgtagcagatgggaaataccaacataggcagtctcatactagaacccaggctcttgcttagcacagggatccatcttcctcttttgttcatgacctaagccatagctgcaaaaggatatttctcctaaaataattgaagacacattggaaccacttgtaagttctgtaattatatttgaataacatttgtgttgctatttccttctctgataattatcctctattctctttccatctgtatggctgtaatagaaacatccatatgaccctgtcttctagaccatagtttattgaaccatgagtgggcatctgactcaagatgagccactgagatctcttctaggctatatggtgtaggtagaggtttcagttttcgcctatcttcttgaacagcaaaaatataaacttgggccgggagcagtggctcacacctgtaatctcagcactttgggaggctgaggcgggaggattacctgagctcaggagttcaagaccagcctgggcaacatggcaaaaccccgtctctacccaaaatacaaaaaattagccaggtgtggtcgtgcacacctgtagtcccaggtaatcaggaagctgagatgggaggatcacttaagcttgggaggcagaggctgaagtgagctggggtcatgccactgcattccagcctgggtgactccatctcaaaaaaaagtaaacttggaagctggtagcagtggccatttactacagtactacatggaccaggtaaaagagaaagctggtctgcagtaaaagaagaataagcaacccttccctggtttactacaggagacagattccataactgtccccaattctttattccccttcctgtatgccactcccttaacattatgactgcaggtcttcccaacaagaggtggagccagtggcccatcgcttagatctggactggacttgtgacttggcaaaagtgacagaatgctagtttcaagtcttaatcacaagaagcttttcatatttacagtttttatctttgacccatcttctccctaagaacatgcctggctggcttgctggaaggataagaagcatagctatggtgccatagccaagatcatcctaaaaagccaggagatagctgacccaccaactgactaaagagacaaagagatgccccctgagatcatccaagcctagtccagatgagcagaactgcccagccaacccatagacttgtgaaaaatagtaaattgtggtttttataagggtggcttgtaatgcagcgttagctaactgatacagttacctgcagttttcccatccattaagatactagaggcctggatatgctgcagtagcaggtttccataactcacacttatagtcttttaataaattttccatttgtcttaagttttctcagttgggtttctgttatatgcaaccgtaagaatcctaagtgatgtgagttttataagatctgagaataacaagaacagcatcttacttttacagagtcctgttaagaggtaaccagtttagtaatagtgtattaaaaagagatacaccgtgagctttgttctgactgcttcaacatgtttggggctggatctctacttttgttttgttggtagtgatattggcagtttttttttttttttgagacggagtctcaatctatcgtccaggctggagtgcagtggcacgatctcggctcactgcaagctccgcctcctgggtttccgccattctcctgcctcagcctcccaagtagctgggactacaggtgcccaccaccatgcctggctaatttttttgtatttttagtagagacagggtttcactgtgttagccagtggtctcgatggtctcgatggtctcgatctcctgaccttgtgatccacaaatgccactaatatataaatatgtctacactgcaacaacttaaaagtctacatatgcctcaagcattaaaatggaaaagttcccctttcctattcccaacctatagtaaagaccctcctcagaggaaccagagttaatagctcagacagctaataaggagcaagaactttaaacttgtacctttactgaaacttggacaattgaaacctggatggagaagataagaacctacataattgtcaaagcagtgaactggattttactgttgtttcttttgcagttattggatctgcttttagggcagattgttgcttgtttgacctgaaaatcctccataggccatttaatgatgtaagtattacactgatctctcacctggatagatgttggagatggtgagcccccaaaacttgagtgttttagcacaaagaggttcacacaggaggctggctgtatgggtaagctaactgttcttattgtatgacaagtattagtctcttcgagataaatgttttattttatatatttagcttaagatctcattgtcttaaaaatgtcacttgttcttacaaataaacattcgtgtttgtttgcaggattgctgatagggaactgagctctaagaagctaaaggagagtcatggcacatggcaatgctgtttcgaggcctgcaagatatttgccagccttctaagccccatgagaaccttcacacaggtaggggacaccatcaacaatggtgatgatgaggttccttcaggaaccgcaatagtaaacatggacccagaggagccagggcagggaggaaagaaggtgatagatacctgttggagatcaggatagatagactacacaacaattggaaataatctgggtgtcaaatattcatacaagcctagtttttaattatagactgttaaagcttgcaatataccagctacagtttatgtaagtatacaccaaaagaaatatttggaaggatatacaccagaacttatacataggatctctgaataatagcatcaagagatcttataattcttgtacttttggctttatgtattttctaatttcttgtagtgtacacgtactagttgtataatttttaacaattaaaaattatcccaaaggggagaaataaaagaatgtatatcacatttcccttaagataaacatctgctttgatttatgcttatgattgtttttaaaggtcatgtgaaagcatcttttgattttttagaatatctttagttaaaatataattttctttccttggtgacctgattatttggagcagcagtatttgggtgtgtactgataatttggtaacatgtcttttatagtcattactggggcttggtttatatgttcttagggatacaatgatagcggtgtgattagagaacttatctaaaagtaaataggtctgcaggccactgaagttacttgtttgatcctgtttgctacatattcaatatccttctaggtttctggagttctgtggagccataacaggaggaataaagaaggcatctgtgtcttcctgcgtgccctaatagaagaacatatatccatggaatcttaaggttggactttcttatttaagtgcatagggtggccagatatcttgattcataagaacagtccccaattttagatactgtcaggccatttgtcttgaaaaataaagtttaaaaagagaggctttagactttaaatgtgtgaattgtataatacatgaattatctctcaataaacctgtttttttttttaaaaaggggatactggtcaggttccaagatggcagaataggaacagctccagtctgcagctcccagcaagattggcacagaagatgggtgatttctgcatttccaactgaggtacctggttcgtctcattgggactgcttggacagtgggtgcagcccatggagggcaagatgaagcagggcagggtgttgcctcacccgggaagcacaaggggttgggggatttctctttcctggctaagggaggccatgacagactgtacctggagaaacggtacactcctgaccaaatactgctcttttcccatggtctcagcaaccggtagaccaggagataccctcccatgcctggcttggcacatcccatgcccatagagtcttgctcactgctagcacagcagtctgagatcaacctgttatgctgcagcttgacagcgggaggggcgtctgccattgcagaggcttgagtagctcacagggtaaacaaagtggccaggaagctcgaacttggcggagcccaccgcagctcagcaaggactactgtttctctagattccacctctgagggcagaccagagcagaacaaaaggcagcagacagcttctgcagatttaaacgtccctgtcagacagctctgaagacagcagtggttctcccagcatggcgttcgagctctgagaacagacagactgcctcctcaagtgggtccctgacccaatgtatcctgcctagaagacacctcccagtaagggacgacagacacctcaaacaggcgggtgcccctctgggatgaagcttccagaggaaggatcaggcagcaatatttgctgttctgcagcctccactggtgataccaggcaaacagggtctggagtggacctccagcaaactccaacagacctgcagctgaggggcctgactcttagaaggaaaactaacaaagagaaaggaatagcatcaatgtcaacaaaaaggatgtccacaccaaaaccccatctgtaggtcaccaacatcaaagaccaaaggtagataaaaccacaaagatggggagaaaccagagcagaaaagtggaaaatcccaaaaaccagagtgcctcttctcctccaaaggattgcagctcctcaccagcaagggaacaaaaccgatggagaacgagtttgacgagttgacaaaagtaggcttcagaaggttggtaataacagatttctccaagctaaaggagcatgttctaacccatcatgaagaagctaaaaaccttgaaaaatggttagatgaatggctaactagaataaacagtgtagagaagaccttaaatgacccgatggagatgcaaaccacagcacgagaacttcgtgatgaatgcacaagcttcaatagccgattcgatcaagtggaagaaagggtatcagtgattgaagatcatattaatgaaataaagcaagagacaagattagagaaaaaagaatgaatagaaatgaacaaagcctccaagaaatatgggactatgtgaaaagaccacatatacatttgattggtgtaccggaaagtgacagggagaatggaaccaagttagaaaacactcttcaggatattatccaggagaacttccctaacctagcaaggcaggccaacattcaaattcaggaaacacagagaacaccacacagatactcctcgagaagagcaactccaagacacataattgtcagattcactgaggttgaaatgaagaaaaaattttaagggcatccagagagaaaggtcaggttacccacaaagggaagtccatcagactaatagtggatctctcggcagaaaccctacaagccagaagagagtgggggccaatattcaacattcttaaagaaaagaattctcaacccagaatctcatatccagccaaattaagcttcataagtgaaggagaaataaaaccctttacagacaagcaaatgctgagagattttgtcaccatcaggcctgccttacaagagctcctgaaggaagcactaaacaaggaaaggaacaaccagtaccagccactgcaaaaacatgccagattgtaaagaccatcgatgttatgaagaaactgcatcaattaatgggcaaaataaccagctaacatcataatgacaggatcaaattcacacataacaatattaaccttaaaagtaaatgggctaaatgccccaattaaaagacacagactggcaaattggataaagactcaagacccagcagtgtgctgtattcacgagacccatctcatgtgcaaagacgcatgtaagctaaaaataaagggatagaggaagatctaccaagcaaatggaaagcaaaaaaaaagcaggggttgcattcctagtctctgataaaacagactttaaaccaacaaagatcaaaagagacaaagaaggctactacaaactagtaaagggatcaattcagcaagaagagctaactatcctaaatatatatgcacccaatacaggagcacccagattcataaagcaagcccttagagacctacaaagagagttagactcccataaaataataattggagactttaacaccccactgtcaatattagacagatcaaacagacagaaggttaacaagtatatccaggacttgaactcatctctggaccaagcagacctaatagacatctacagaaccctacaccccaaatcaacagaatatacattcttctcagcaccacatcacacttattctaaaattgaccacatagttggaagtaaaacactcctcagcaaatgtaaacgaacagaaatcacaacagactgtatctcagacaacagtgcaatcaaatcagaactcaggattaataagctcactcaaaaccacacaactacatggaaactgaacaacctgctcctgaatgactactgggtaaataatgaaatgaaggcagaaataaagatgttctttgaagtcaataagaacaaagccacaacgtaccagaatctctgcgacacatttaaagcagtgtgtagagggaaatttatagcactaaatgtccacaaaagaaagcagggaagatctaaaattgacacgctaacatcacaattaaaagaactagagaagcaagagcaaacaaattcaaaagctagcagaaggcaagaaacaactaagatcagagcagaactgaaggacatagagacacaaaaaacccttcaaaaaatcaatgagtccaggagctggttttttgaaaagatcaacaaaataggccactagcaagactaataaagaagaaaagagaagaatcaaatagacacaataaaaaatgataaaggggatatccccactgaccccacagaaacacaaactaccatcagagaatactataaacatctctatgcagataagctagaaaatctagaagaaatggataaattcctggacacatacatcctcccaagactaaagcaggaagaagtagaatctctgaatagatcaataacaggctttgaaattgaggcaataattaataacctaccaaccaaaaaaatccaggaccagacggagtcacagccgaattctaccagagatacaaagaagagctggtaccattctttctgaaactattccaaacaacagaaaaagagggaatcctccctaactcattttatgaggtcagcaccatcctgataccaaagcctggtagagacacaacaaaaaaataattttaggccaatatccctgatgaacattgatgtgaaaatcctcaataaaatactggcaaaccaaatccagcagcacatcaaaaagcttacccaccatgatcaagtcagcttcatccctgggatgcaaggctggttcaacatacacaaatcaataacataatcagtcacataacaaggaccaatgacaaaaaccacatgattatctgatgcagaaacggtctttgacaaaattcaacaccgcttcatgctaaaaactctcaataaattaggtattgatggaatgtatctcaaaatattaagagctatttatgacaaacccacagccaatatcatactgaatgagcaaaaactggaagcattccctttgaaaactggcacaagacaagaatgccctctctcaccactcctattcaacatagtgttggaagttctggctagggaaatcaggcaagagaaagaaataaagggtattcaattaggaaaagaggaagtcaaattgtctctgtttgcagatgacatgattgtatatttagaaaaccccatcgtctcagcccaaaatctccttaagctgataggcaacttcagcaaagtctcaggatacaaaatcaatgtgcaaaaatcacaagcattcctatacaccaattatagacagagagccaaatcatgagtgaactcccattcacaattactacaaagagaataaaatacctaggaatccaacttacaagggatgtgaaggacatcttcaaggagaactacaaaccactgctcaatgaaataaaagaggaaacaaacaaacggaagaacattccatgctcatggataggaagaatcaatatcgtgaaaatggccatactgcccaaggtattttatagattcaatgctctccccatcaagctaccattgactttcttcacagagttggaaaaaactgctttaaagttcatatggaaccaaaaagagcccacagagccaagacaatcctaagcaaaaagaacaaagctggaggcatcacgctacctgacttcaaactatactacaagactacagtaaccaaaacagcatggtactggtcccaaaacagatatatagccaaatggaacagaacagaggcctcagaaataacaccacacatctacaactaatctttgacaaacctgacaaaaacaagcaattgggaaaagattatttaataaatggtgctgggaaaagtggctatccatatgtagaaagctaaaactggatcccttccttacactgcatataaaaattaactcaagatggattaaagacttgaatgtaagacctaacaccataaaaaccctagaagaaaacctaggcaataccattcaggacataggcatgggcaaagacttcatgactaaaacaccaaaagcaatgtcaagaaaagccaaaatagaaaaatggaatctaattaaactaaacagcttctacacagcaaaagaaactatcatcagagtgaacaggcaacctacagaatgggagaaaatttttgcaatctacccaactgacaaagcgctaatatccagaatctataatgaactcaaacaaatttacaagaaaaaaacaaacaaccccatcaaaaagtgggcaaaggatatgaacagacacttctcaaaagaagacatttatgcagccaacaaacatatgaaaaaatgctcatcatcactggtcatcagagaaatgcaaatgaaaaccacaatgagataacatcccatgccagttagaatggcgatcattaaaaagtcaggaaacaacagatgctggagaggatgtggagaaataggaacgcttttacactgtcggtgacagtgtaaattagtgcaaacattgtggaagacagtgtggagattcctcaaggatctagaaccagaaataccatttgtcgcagtgatcccattactgggtatatacccaaggattataaatcatgctactataaagacacatgcacacatatgttgactgcagtactattcacaatagcaaagacgtggaaccaacccaaatgtccatcaatggtagactggattaagaaaatgtggcacatatacaccatggaatactatgcagccataaaaacagataagttcatgtcctttgcagggacctggatgaagctggaaaccatcattctaagcaacctatcacaaggacagaaaaccaaacaccacatgttctcactcatggactcagggaggggaacatcacacatgggaacctgtcgggggttagggggcttggggagggatagcattaggagaattacctaacgtaaatgacaagttgatgggtgcagcaaagcaacatggcacatgtatacctatgtaacaaacctgcacgttgtgcacatgtgccctagaacttaaagtataataaaaagataataaaaataaataaataagtaaaataaaataaaaagaaggggatacaacagaggggtgacatattagtacaataaagaaagcacattgccctgagctcaataattaattgttgaatgaatgagtgaacaatagcttgaatacagataaatattaaattgacctgtttttgtttaaagtagtctctgtgctcaaactgtaaaattagagttgatttgtaagattactgtgagtatcaagaagaaaaataataagagttctaaagatgtaaatacatctcaagttatgagaacaatttttaatatctgatgatggtatatgtgggatcctacccctaagatgacctccaatgattcccacctcttagtattcacatcctatgtaatccctcccacattatattagggttgatctgtgcaactaacagaaaatggccgaagtgatggtttgtcactcccaagactaggccataaaagacagtgtatcttctgctccatcccctcttctctctcagataatctgttctgggggaagcccagctcctgtgccatgagcaaccccatagagatgcccatgttgtaaataaatgagccttccttttaacagccaaatgagtgagttttgaagccttcagatgactgcagccacagctgacagcttaactgcaattttatgaaagactctgagccagaaccacccagctaactccctcctggattcctgaccatgagaaactgtgtgtgataaatgtcgattgtcatataagctgctaaatttgggggcaatttgttatgcagccttagataactattacattagagaataggagaactgacaaaatgtagagattccagtcttatgtaacaatgtaggcatttctagaaaacagaaaaccaatgaaattctataacacctgatttgccttgggccttctatcctattaattcctttccctccacaagtttttaatgtgcttgactggaagattttactctcctgtggaaacatttctagttgtaaaatgagcatccatagaaaattcagatttactttaagttggttatgatttattctctgtaaaaattaatgtcctttcttaaacactagaattacttttcctataataaccataaaatttattatgtgagaaagatgatgttacacagaagtaagtttagttgagaacaatcaacaaattttaagacctttttctatcatataattttctattatggttttgggggagggatagcattaggagatatacctaatgtaaatgacgagttaatgggtgcagcacaccaatgtggcacatgtatacatatgtaacaaacctgcatgttgtgcacatgtaccctagaacttaaagtataataaaatacatctatataaaaaaaagaaaatagataattttccagttgaatcaaactagagtgcttttgacagatgatatctcttttgtagatccatagttcaaaaacacaggaaggagttacagcccactgtcagataaagcaaatttaatcttagaaaaaactatcctcactaatgaatgaaccaaaaagaatttccttttactagtttaactgtaccaatttattgcaacaaatatctccaaaagaatgagtgtaagtgatgagaatgtgatagtatttataggttgtttgtccatcctctcctttacttctgaacagcctctcctgatcacttgcatggccataggttaaaacgtggcagccatgttcatcaaacatcagcccttggacccagatgattgtgccaaggtgaacatctgataattctgaaaatttggaatagtgagtggggaagggagctaagaaagaattgggattgattttgtttttctcaggataactggacctatgacatataaacttgggagcagtcttggccatgttttcatcaatgtagtaagaagcagaggaaaactgttggttaagaggaagggaatgaatcagaaatgcagagaggagcatacatagaagtcaagagaatgtttccagctccatctttgtcctttgattcctcaagatattcctgtgtttttctaatatatttgttaagctcaagggggtttctgttgcttgaaaataagagttttatctaataaagaaataacatagtgctatatcctaaagggttagttaagaaattgggaaagatttgactatacagctattcatcacagcactggaaacactctaaacattcaacagtagaggactagtacatccattatgtgcccaatatcaatcatattataggagaatattagggtaggattacacgtatataatagatgttatgaaaaaagcaagtttgggaaggttatttgctaaccttcccaaatgataccatttatgttttaaattatttatatataggcataccaaaaaattatagtatcatgtaaacaaaaatgtcaacattctctctgatagaattgcaaaacgttttattccctccttttaaaaacgatctcatggctatcataatatctggtttcaattgatattaagcaatggatgagttctctgttgtttttaaacttttatatcttttagttttgcttactcaacttgcagattgacaaatatttcatatattattttaattttctttttggtgtgaatctttatttgtcctaattttttcttgttcctcatcttggtgcctacgtagtctttgttcttaatgcacaagaaatccaagttccttattgataaaaaagttaaaaagcaacagagaactcatccattgcttaatatcaattgaaaccagatatgatagtcatgagaatgtaaaacaagaaaaaaaccttctgtaaattatagtttgattgtcacagttatattatgtggataaacaaaaggtttataacaaggcattaaataaacaatacttagtttataaggctcactcattctctgggcagctagtcactgtctcaaatttcactcatatagtaattgtttaatccaaagtgaaagtccaacagataataaacacaccctggaaggataatggatgctaaaatctaagcacactatgataaaatgtcatctatatttaaagtagatggttaaaaatgaccagaaagaaaatattcaatggaaaaagtggaaaatgaccagattgcatattgaaaacatttttgcagaaacagattgtctaaaccagaagtccccaacctttttggcaccaggaaccggtttcattgaaaacaatttttccatgacaggaggggcaggggatggtttcaggatgaaactgttccacctcagatcattaggcattagattctcataaggagcgtacaacctagatccctcatatgcaaagttcacaatagggttcacactcttacgagaatctaatgccactgctgatctgacaggagccaagctcaggcagtactgcttactcgcccccactcacctcctgctgtgtggcccagttcctaacaggccatggaccagcagggggttggggactcccagttcagatcaagggtttgcagcctgggggttggggatctaaaccatgatttattcaaatataaaaaaatcaaattcaaactctctctctaaatacctgcttggcatctcaccccctaacctgttttataccaaaaaacttcaatcacaagatggggttggcagtatttcagaaatgcttttcaacagtacaacaacctttttttagaaactaggattagcttaacacaaatatgggtatgtaaaagtaggcactgagttatgcaatatttattcaagtggaattcttccaatattttctggaagagagttacttttcaataatgctgttctgtggaccaacatcttagagaagagtgttcatcttttttaaaaataagtgttcttatgtataaaaaatgcataagtgtgtaaaagtaagatacatattagattttctatgtaatcgatgattaatttcagcaaattttatttgaaaattttaaaattaggatttttttctatgaaagttctctccattcgtttttatttccattttttaaatcctgacaaaaatgaccatactcggatctacatgcttctaacttttctcctttagttcattattaacaagcttgttacttgtcaagagtgaactatctccctctgcattcgtctgctcagtaaaccatctccattactgtctccatctcttcacttgtctattctttatttccatcttgagcctattcattctggtctctaacctgatggtggaatggaactgtatgttcttcccactcatccaccattacacatagctctaaacttgtctgttttcctgagtgctcagtagctgtcctttctttttcctctggacttctgaaatctgaccattgtctgaaattcagtctatagcccattggtcatctcttcataaagtcttctttctcaagaactcattcatggcctgccatggtggttcacacccgtaatcccagcatctcgggaggctgagatgggaagatcacttgagccaaggcattcaagaccaggctaggtaacatagggagactctatctctacaatgttttttaaaaaaaaattagccaagagtggtggcacgtatctgtggtcctagctactcaggaggctgaggtgggaggatcgtttgagccctagaggtcaaggctgctgtgagctgtgatcgtgccactgaactcacttctcaaagaaaaaaaaaagaactcatttatcctcaaggtttcaactgtcacttgattcctgcatcttagctccaattgcctactgggcatcccactaaagttatggcctcatctaggatagaactcattattggaccatctgagcagattattgtcagtcttcattgtttcattactaagtcctatcattcttatattgattcttttcttttctttttttttttttttggagacagagtctcgctctgttgcccaggctggagtgcagtggcacaatcttggctcactgcaagctccgcctcccagtttcacgccattctcctgcctcagcctcccaagtagctgggactacaggcgtcagccaccacgcccggctaatttatgtattttttcgtagagacggggtttcgccgtgttagtcaggatggtctcggtctcctgacctcatgatctgcctggtttggcctcccaaagtgctgggattacaggcgtgagccaccgtgcccggcctcttatattgattctatctctcaaatctatcttttcacttctctttgcaattactgttcttaggctatggcttcattatcacattgatttctccctcccctggtctgacattagtctttcaaaataaggctaagacataggcttgcatattggtagtttatttgggcaataatcccaagaagcataactgacataagagagtaggacagagaaggagggagaatgagttcaaaaatgccttattgaattggccaccactatgggtaactgatgctaggtctcaccaggatcttataatgagtcttacgaaattcatctcagaaaatccacctgagaggtgaaaagaaaaaatatttatttatgagttcttggcctccattgattaaagatgaccctactggcaatacctcccctgcacttcctgattgcacatgtgtgtgtctgagcgttcttctggcctccaccacggcattagagaagttctgcacaggcaagagacaagcaaataaaaaacaaagacatgggaagttgtaggtaaatgtttggggcttaggtgactgttgtccagttgtatcaacaagatgctggtccaaacctattatagcagcttctagagcaagacatggcagaaagaggacttgactggttcataaaaggcatttaatacaccttttatttagtttgttgtgtgggtctcttgtttcttcagcaggactctaaatgtctcagtgacatatatccattcagtagaattaagacacttgctaaacgaatcattcaatcattcacattcaattttctcatgatgttaaaatcttaaatatttccagttctattttctcaataaattgcctaatttagtaaaattcatgtcatatagttaactctctggaattttaccaacaactaccaccagccctctctggatctgctcccagtattgatgtcaaagcattcccacccactattattaaagcttatattttgaactcttttctcctgattatattgtgtttcatgtttctattacatcgttttcctcaagaccatggaacctctgtgtaggaagtttgaccagtttagcaacacagtcactggctaaaaaaaaataaagaaggtgaatggactatctaagtttggaacactgggctcattagccctcatagtccagccatctaagctagactatattttgaaatcttccatctgtagattaagatcaaattgttccagtaactttaaggttgcttttcattacatttacttatctttacaccctacagcttagatagacattttttttttgcattctcttctctaatctattccatcaagatagttcagaaaaactgtagcaattcatattagttcaggttagatgatgacactcaggctgtatttatgtcctacatgcaaatagtgtttattttgagaatgttctaaaaatgagaaggggaaaataaattcaccttctttatcctttgggtacaatataacatccacagaacttatcaagctctttacttatcatcaggggttttcaaatgttgaagataaagttttcagaatacctcccttaaaggaaatttggggagtcatttagacctaaaataaatgcgcttattgtttttaaagacactaggaaaaaagttagagaatttgaaaaatatactcattcatttaacaaatattcactaagcattctattctgaaaaagaatataagtccttgtttatcactttaaaaaatctttattttcccacttatagaacattaaatacattttctgcaaaacaaacaaactaaaaacttggaaaatataaaagcacctttaatcacaccactcaaaggaatactgttaacctccaatggatgtctccattgcttcttcagtagaatccccccaaaaatgtttttatgggttgaaagcattaaaaagagtctctatttgggtagactcatttctaggtagtgagattgtatcttactcttcatggtatcaaccccaagagctgacacatactatgtgctaataaaaatgtttaggggatagttcatcagtcttattagaaatcagacaaaatcaaaatatattaccaaatgaactcaattccccatagtacctgctgtgaagcaggacatttagaatgcttagtctcattaactaattctaattacaagtagatgtgcacctatcttgaatagagtttctctatgtttatcacaagatgataaactttggtgttttattaggaatgatatttggtggcacaggcaagaaaagtccatccttatctggttattgaaaatcaggaatatgctatcatttggagtacaaatggtagcaacagtctaaaattctctgcaccactttgtttcacaccaaccagaggaataaggcaaagactgattgacaaatgtcagtaactcatttttcacatatgacaaaaagtgactaaactgataaaattatcatttcaatgttcttgccagaaggctcaagtaattagcaaaactaaccagcaaaaaaagagagcaaagcccattatttttcttatgtttagaaattacataagtactttccttcaaaaataaaggttttccagccggtatctgtctgctggatataaacaattagcctgttttaatatggaattttcccttttatttttagtattagaagggagattctaataaatctatgaggaggagcatcaccccttatttgtaacctcaggacataaaacaaatatttccgacccccttcaaagtgtggagatgggtcccatatttgtaaaactaagttctttttacctttaaggaaatgaaatcagcttttagtctgccagtgtttttgctacagttttaatatgcagtcaaactttattatgaaagcctacagcagatatttggagctaagagacaaaaaaagtaacatgtctagcatgggagacctggggaaaatggacggtggtgccatttactgaaatgggaaaggcagaaaagcaggtttggggaagctggagaggagttctgtgtggctccttggcgtctgtggtaacagaattcaatcttggttgagtctgtggcactggtttgtttaactgagcttctgccttggtcctgtttttcattctattccgataccccaagagaaatgaatcttgcctcacctttgccaggcctccttactgggctcttgcctcacctctccccttgaatagcaggccagtagagacaggccatccaggtgtcacttctgatcaggctttcaaggttagctacctgccttacctagagttcatgagacccttttatgtcaaactctctttgctaagatatggatcatcagtcattcagaagtcaggccccttcctgacttgtctgtcttgtggacaattggctttatcccagtgagttctgagagagacagttgttcaattaagagaacagatttttcagactattaatctgttagctggagaaaataaggtgctatgggacaaatggttagttgtgtataatacgtgaacctaggaataatcatcaggctcttgaagacctcatcaagccaggaaatatatgctagttagcttcagtggtcttcaagaagaggctctgcagctttaagtaatgtatctcaaagcttgcaaaggcatttttttccaaaataagccttaaaattataagtatggagttagagtcaccatgtatatttgaattgtacagtgaaccactgggataattcaggctgagtccataacctcttaattatctttgatagtttagaaaaatttgtgcttcctatcctgaattaccagttaattacagctgtaaaccttacctactgtcttttattgtaaatgatgttctaatttgagttggcactcttttaaatgacattttagggttcaacgtctttcctaggagatagagaaaacttaagaaaaaggtcttctagaaccccaagtcttgaaatagctgccagtaaaccaggaacaaattccatatcaaaaagagcctaaagttcatctctattctgatacacatagtcacaattctaattttctagtatgaaaaacttaatcaaatgaggaaatatcctggttttaaaatgaattgatggtttgtttaattaaaaatattaaaattttttataataatcatatttcccaaggctgccaaactagttccttcttccatattgtgccaagctatttggccagctacatggacagtgaccttattttattcaagtatactacagaatcagtgagtggttttcagctctaaatttactccctctggtgatcctgctaattataaacttactagccttcagggaatggtattaaatattttcctcttttggcaacttagtctctgaattctaaatcgaatgatgctttcatgtcaaatgacccattcgagtgttttttaaatgtattttcataagatgcagcatatatttttagcaactagtaaataattatattaatatacttataccaattgtttaaatcataatgaaacacttactgacaaataaaatagcaattactgatataaaatggggaaataattttactctcctgcatttgtacagagaacatttgagtaacagttttcccaagcaaagtaaaccaaatatttatctggtggatttaggcagcagaacacaacacagagagtttacatgtttcaagaagttacatacctcctgcaagcgatataacctaatatccaaattatcttagtcaatttgagcttctataacaaagtactataaactgggtgacataaacaatagaaatttatttctcacagttctggagactgaagtctgagttcacggtgctagaacggtgagggactggtgagggtcctcttctggttgcagactgccagcttcccattgcaccctcatatggtggaaagacagctagctagctctctggtctcttcttttaagagcactaatcccattcatgagggctccactgtccaaaggcccttccatcaactactatcacattgggattatagtttcaacatacgaaatttgggaagcacacaagcattcactccattgcacaaatcttctgacccatcctaaacttattaggatttttctcattccagttacagaaatctcatttgaaagtccataacattattaagtagcaaaaaatgatgatatccatccataagattcattttccccactggcccttagtggtcctttaaatactaaacatttataaacaattgatgacatgagaggattccacaagcaaagatttcactcttttgtttcacctctgataggcaaaaagccaaatgaggtgaagtggatataggtttaaaaagagacttgagtgacatcccagggtactgaaagggaatgaagagaaacttaggaaaggtagaaacagatctcagcagatgttaattttcttgagttgctcaaattatttaggacaactgcaatgaattctaagtcaacagtcaggaagaaattgatttggaaaagttagatggggagtttaattgaatatgagaaaaagcaatgaatcagcacttgggtaactgcataggaaatgctgacccaggaattaagcagactggctgatctgtaaaatggatcaatgttagaaataaaaatcaccataatttcccatctgctactggcatcaaggcagaaagactagttttcaaataataataaaagcaaatatttatggagtgctaacttaacagttttgccatattaccttagttattctcacaacaacctgtgggaactcactgagacccccagagttgatataaagattattctaaagacatttgaaattcaacagatgcagaaaaaagccttctcagaacttaccttatctcactaaatgcagaaactactgggagtgaggctgccataaatctcttctggagaattttactggccataaagaagacagagaagaccgcttgcacctgcataaacaaacattatcacaaaccttcttctttttcatttcttcccctaaatactcatttgttcttccctacatagagggctttactccccccttcttctcccccattaagtaacctctcccctattaggtatataaacccccatctttagttgtttagagtcacatttttctgtgtgctcctgcgtgaataaaaatctatgttttgtctaagtttaattcccaggccctcaagaactgaacctaagagggtagaggaaaagattttcctctccaacaaacattacttacaaaggtaagtaatttcatcttcattaaaaacatgagaaaacttagactcaaagaagttataaaatttgcccaagttcattaaaccagaggaatgaggattcaaatcaggttaggctaggcacggtggctcacacctataatcccagcagtttgggaggccaaggcagacagatcacatgaggccagcctggccaacatggtgaaaccctgtccctactaaaactacaaaaattagctgggtgtggtggcacatgcctgtaatcccagctactctggaggctgaggcacaagaatcgcttgaacccagaaggcggaggttgcagtgagccaagatcacaccactgcactccagtctgggagacagagcaataccctgtctcaaaacaaaacaaaacaacaacaacaaaaaacacatgcaagctatattatcccagagtctacactagtatcacttcattaaattgttcttacatggtctagaggctttagcagcccatgcaaatgggcagatcttaaaagtgattcttcttagtccttaccatcaggtgtcctaattctgaatgttttggtatttaccaggagggacattatttgggtgactgcaaagtttacctaaattatttggtaaaagcaaagataaatgaagcatttgactttattttacttccttcacaagccagtttctaaggttggtatgtttaattcattggaaaaaatttcttacatacaactgaaaactgactcaaggtaaaagaatccagcatgaataagacttgtaatttctcacagtcagtaatgaggaaattgaacaggcaataaacaggacatttaccaaccagaaaccaatgccgttgaactcccaaacatgttccaactttgcacagctgaagaaacagccactgaattgtcattactagcagccatgaaggaagaagacagccagccaagatcatggtgaatcgactgcagttcaaaggatacgtagtaaaggagtaagctggggatgcaggtgaaagggaagtaggatgggggtgtaaaggtaaaaagaacgtctctgtgatagacatagacaggaaagcaagcactgaagtaggcagcaccacagagctgtgttaaagacaccaagacagatattactacctccctccagttaaaataatcaagatgaattaacatgcatagatttcctggatatttttgagaaaaaaaacaagatataaatcaatacgtgtaacatttttgcttttaaaagtccacaaaatggtatatatttcccagggatatacacatataaatgtccatctatatttccacaataaaaagactggaaccataccatggaaataaacagagaccacccaaaatgagaacaatcagaggctatttattcattgcttactaaaacaagggagtcaaacaccatcgcttgtgtttggcagatactcacaggcagccaaagcagaaatgaaaagctttatagtgaaaagagggaagattcacaaatgctacaattggaaacttggtttgggaagctagaggtgggtaattacaagtgagccatcttatgtgattggtttggggagtacatttggctttgtctggttggtcctgagttaaaagctgacagtcattgaccaagcactgacacttcagaaccaattgtatcagagcttgtggtttggcttcccaggctggttgctgcagaggttgtgtgtccgagttctattgacatatatggtctggtccttgtccgtttgtatatttagtctatcagtatgcaccaaactaacattagtggttactactggcaagatgggaagggatagggtcagcaagtaatttcatattttgtaattctaaatttgtttgtaaggagaatatatttactcatttttttacttgtataattttgtaaaattctgaagcaaaatggcagaagattgatagctgtcattcctaatcctcacaacactgcaagatgggttgtattcttattttacagtggaggaaagtgaggcactaacaggttaacctgctcaagaccacacagttgataaatagcaaatggaatttaattccaggcatatctgatcctaaaagttacttttcactatgccatgatcctgcttacaaatgtatagttatactaacattaaaagagagaatgggctgggcatggtggctcacgcctgtaatcccagctctttggggggctgagacaggaggatcacttgagcttgagaccagcctgggcaacaaagtgagatcctgtctctacaaaaaatttttaaaaattagctgggtgtagtggtgcatgcctgtgatcccaggtacttgggagactgaggcagggggatcacttgagcctgcagtaagccatgttcacctcactgtactccagcctgggtgacagagcaagacccggtctaaaaaaaaaagatcaggcgcagtggctcacgcctgtaatcccagcactttgggaggccaaggcaggcggatcatgaggtcaggagatccagaccatcctggctaacacagtgaaaccccgtctctactaaaaaatacaaaaaattagccaggggtggtggcgggtacctatagtccccgctacttgggaggccgagacaggagaatggcatgaacccgggaggcagagcttgcagtgagctgagatcgtgccactgcactccagcctgggcaacagagcaagaccccgtctcaaaaaaaaaaaaaaaaagagaatggccatttttactccttacaaagggtgagcataacatattggattaacccaatattgcatctattagtacaatattagcatctatttactaaagtggtgttagaactcagaaatggctgttgccattgcaagttgagttatctgaagttacagaacttgacacgacatcacatgacagtcctgcctgaagtctgattctttgtacttccagaagggtagctttggcttttgagaaagagatagcatttaaaatgtagttataactaatgagaaagtaggtatctttcagaaaattccttgtagagcaccatctatcacctatattgttgataatggtgttggccaatttctaatctaggaaatgctaatgaatcaatttcctataagtttaaagcagttgtgtgaaccagctgattgtttttcacgtggtaatgtagctaacttaactttgattaccttggtgatcaagaacttgtaaaggtacctctaaattaagaagggctaaccaattgttgcaggattaaactcttctctttaaaatctttaattggaaccacaggttgtaatgatctgtaatttaaaaaacaacagtttttatgttgggtaactacaaaactcacatggaaaaacagattaatatctataaacatttttgctatttactgccctaaatattacctcgagatttacatagtaactcagggcttctcaacactgaaacagcacattaaaatcacctggagagcttaaacaataatatcaaggccctcctcccttcctccaagattctgatttaattggtctagggaaggtctctgcatcagtatttttaaaaagatcactaattgattctataaggcagcctaagctgaaaagcactgctatagatgaagatgataaaatgaaaaggacttcatgatgcggttcagtttgtttaccagcatccatccctttggagaatcattatttcctatgctgtgaggtcctggtaaggctgaccctgactcttctcatccatagcgagtcctcatagtgtgcacatgacccagttcagagtaatgctttgtatatgttgatgctatataattagatacacatacattttataccctcatggtggcttagtatttttgtcattatgaagcatacattttatttttacaaatgcttttaccttatagtttgctgatatggtttgaatgtccctgccaaaactcatgttgaaatttaattgccattgtgaaactgcctttgcaaaaattataactgagagaattatgacagtgaaagagatctgagctaaccaacgccatcttgcctttaacctcaaactgtccttgatcattcctgggtgtaggccaagctaactttgggataaatttaatttatagtttaaatgaaaataacacttccccaaaactaaaccacctttataaaactaatgaaaggccaccagattaggaagatgagaggggcctgaatcctgctaaaatacaggtataaatgattaccagccattattccagaagtcaagaaatttattaacttcttccattactcctgtattgattttttgagatgtcttttcaggcttttgcacttctgactaccagatagccccatctggacctgcaattcgggattcaaccagtcatatggcccccacacagaagcagacacagtgcaggagggctgctttccacacccctatgattgcatctccaaccaatcagcatttcctaatccctaaacccctgcctgtcaaactatcctcaaatagcctccgaattttcagggaggctgatttaagtaataataaaattcctgcctcctgtttagcttgatctaacatgtattaaactctctattacaattcccatgtcttgataataggctctatctggacagcgggcaaaatgaacccactgggtagttacaattgtaatagtgttatgaagtggggtctttaagaggcgattaggtcaagagggcagagcccttatgaatagatcaaagccattatgatgggagtgggttagttatcactggagtgggttcctaataaaaggatgagtttggccagatttcctctctgtctggagtatcacaatttaaacatcatgcttgtaaacagtacagcattgactttgtcacttaatgaagtattttcttcttttacatttaatgtagttattgatatgtttgtatttaaatctaccattttatgaagtgctttctgtttatattgtcttcctttcttgttttctttttggatgcaattttaattgcattttgccctctgaattatcttgaggttatataaaaatcacttaggaagatactactgtttctttttattatctaattaattttgcagtcatattttattttcaagcagacatgcaacaatacgtgtttcattttattatagtcatgagaaaagcatgtttgaaaagcaagccattataattttgagagaagttctggggaacttcctgggggaggtgaatagtcatttgatcctgtgatctacattagaggctggcaacctatatcccatgcacaaaatataacccaaagactggtttcagatggcctgtaagctaagaaagggctttacatttttaaagggttgaaaaaaaattaaagaaacatatgtgacagagaccatgtattatcgatctggccctgtacagaaaaagtttgctgatgactctcctatatcatcttgccaagacctgtaaaggtctgagagttttcccctccttgcagaccaataaattagcttgctacaatttcatggatgctagtgggagacaggataacccagtgtaagaaacaaaggactttgttatttacagcaatagcagtcatcagaacatcagcattagtaccaattccttatgccctaatttccaccaggtaataagaagagagccaggtgacaccagcatgcacagtagctgtgttacaggagaggataatgagcttagggcacccaaatcttttataatggacagtaagcacacctgctctttgctctgcagggagacattatctcaatcttccaaggctgtttgctattacaaattacaaatatttaagaaaagatagtttggaacaaagtcaatgcctctaattacaagatatagagaaacacaagagaatcatggagcactgtgatccaataatctaaatttgtatctatagcggccttcagattttataatagttatatcatttcaaaagttcatctgagccaagtgctaaaatattttcagtattatcttaaagggtggaggaaataatagttacatcacctcatagggatttctaaaggcaatttaaaatcttaacgtttaaaaaattattactcagctatttaaaaaattctgatatgcagaaggactgatttatggtatgggccaggtaagtgataacttactctacagtcatcttctaactaatttggtaacttgacattttctttggtggatgcataaactatatcatgttctataaaattttattactacagtccaaaatgttttaaaattatcccagaatttggctaggcacagtgtacagttagctgtaatcccaacatttctggaggccgaggcaggtggatcacctgaggtcaggggttcgagatcagcttggccaacatggtgaaaccccatctctgttaaaaatacaaaaattagcctggtgtggtggcacacgcctgtagttccaactactcaggaggctgaggatagagaatcgcttgaacctgggaggtggaggttgcagcgagaaaagagcgccactgcactgcagcctggacaacagagtgagactctatctcaaataacagtaataataaataaataaataaataatcaatcccagaatttaatagtacacattttacagaagaaacttaaacactttaaggacattttaaaatgtattgatttaacaagtattatagttgatatttaacatctagaagtagagctcactaagtagttttctcgcagcattataaatggaacagtgtttctaaaaattatgacttttttaaaaagaattcttttacaagataaatgtttacaaggatgtaaactatgtaacatttagttaaatatttaacaagctgcttctattagaaacagtaaggtgtaaaattgggaatctttgagaaaatctagatcatctttaaatgtctgatatgggacagttagcagaattctctaatatgaaacctttttaaccctagaaactcaaagtatgaaatccagtcagaactgatctgatgttgctttaatataggcctgagctggagagctctggagaaagcaagattactttggggacaatatggaatccctttagggacaatatggaatctcttgtgtccaactaagtatggtctagtagctttgagtttctagcctactgaacaaaagctgcagctaagatctgatgttccactacataattttactgagtaattttaacataactttataacatataggaaggaagaatataaactaaaaaagtcttgcatgattagttgctcttcactacttagtgtttctatttagatttgttcagtctctttactatagtttgggttaaactataagtcattttagctgaggactaagtatggactaggttcatgtggactatttttatatattcatatactaactcatttagacatccttaagtgttttgataaaatcatattttaactgttctattaaaatatctattatatgctttccaaggcaaatatagaatatagaaaaagtccgcataaataaatttcatttcatttcatttatcacatgccaacatttaaccaaataaattttatagagatgctggaacatctgctagtctctgatagggtgttctaggtgaggtgaggaccagcagtttgaaggaagtttggagaaaaggattactttatgtctggtaagataatgttctttactaataaaactttcccacctattgacttttaggacgcctgaaggaaaaagaaaataggaatcatttaaatgttaaacacattgttaaacacattttttttgacaacccaaactcattagatttatcatattcatctgtctgctgtgatttttttttccctaggtgtgttctcacagacttctttgaaaaaaagaaagaaaacgggctgagttatatgtgaactaaatttacctatcattatacatttacaagacaaatggcaacacaggaaatgggcttctaagcaatttggaaattatatataacctgaaagtcacaaagaagattaaaatttatgtacaaaaagttataaacaaaatataaaaattaaccacaaaatgggaaaaatatttgcaacacataatagacaaaaacattaatttaatttacaagttttacaaatcactaaaaaaatgcaacttagaaaaataggcaaaagatattaacaggcagttgacagagaaagaaaagcaaatgaaatcatgctaaacttcactcataattaaataaatgcaaactaaaataagttatatttttcaactatgagagcagtaaagataaaatattctgacaacacacaatgttggcaagtagcagttcatagaaatgtaaattaaaacaactttttagagggcaattttgccatacccatcaaaattaaaaatgcttgtactgtctcaactgtaattttatagctaggaatttaaatgaataaactctcaaaaattgcaaggttcattttccagtgtactcactgatccattactggtaataacaaaaaatggaaaataatctaaatctccatcagtctgcctgaataaattattatatacccaatcaattcaatattatttagcattgagcagaaagaatcatacatcgtgttaaaaagtgaataaaaaaacatgtgcattatgatccgtttacttatatgaagaaatatatataaattttttcaggaaacgaaacaatgaggcaactaaaacagatctttagggagaggaattagtagacttcatttttcattttatatctttatgcctgatttaaacttttattttgccacatatatgtaaaaaatttgtacatatataacatattttaaataatagttattgtagtactattaaataatattttagagaaaagaaactacacagataattgttcacaggcccagtcattcaatatatatggtatagaattcatctcatccacattgagataccttttcaaaacaatgactgcaaaaaaaggggtttccattctttttagatgttatttttaaattcatttcataataaaatccaataccatagtataactcatttttttccctttctccagaaactttaagcaaatacttgaagttatagtaaaggatcttaaaataataccattcttggttcaaccacttggggaaacagtgtgtctttatctattgaaggtgaagctatacatactccatgaaccagcaataccgtactaaatatacaccctagagagaaatctactcatatattcaccatggtatgtgtatacaaatgttcacagcagagtgtttataatagcaaaaaacaaaagctaacctcaaaactactaaaatagtaattaacattagaatggctatattaattatggtatatctatacaatggtatatctatacaaagaatcatccttaggcttgcagaacaaattttaaggtttgggcatttataattcaaaaataaagtacaaagaggctgaatatggaactgtgtccaaaccatcataataaaaattagtaccagtacagagaagagattctatatttagattagaagatggaacttctaattacttcttcattattaaacctttaatattcattcctaaattagatttagccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctctctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaaccgtaataacctgcctttaccttcatactcatgtttttaaaaactgccatattgaacctaatagttttggcccacatttaaaggaagattaaattacttggaaagggcccagaggacagtaataaaaataattacatacttagaaatttggtcctataatgacatgcaagaggaaatcatttagaaaataaaactgaaaataaccttacacttttacgggttaccataacctctgaagaatgggacaagaagccaaagaattgaattataatgagaataatttaatttagtcattaggaagaacatcttattcctcaataagtatttgagtgattattaatgtccaatgctatggcataaggacttgtaaccactaggatgtgttactagaaattattttcttaaaagtgtcagaggtagaatattgtgcaaagtaggggcttattacataaccctttaagatcttttccatatttatgatttttacaaaatttcaggcatctagaataattataaaaacatatcttatttttatggctttttaaaagtgaaaatagattaataattaagaaatataagaggataaaaatattagagatttttcattaacattgaggaaaatataagtatacagttagttaggaaacgcattatattatttgactccataaaggggaagcaattaaactaattattaagatatgagtacatgtgtgttaagtgtcagtatttgtattttaaatctctttttttttaaagtatagtgcaatgtagtgaatgcagacaaaatgttcctataacatatctgtacagatttttttctaagacgggagtcttgctatgttgtccaggctggtcttgaactctggggctgaagcgatactcctggcttagcctccctagtagctgggactacaggcacacaccaacttaccagtaacacattagttttaaggggctcagatgaaggaaaataaaatggatttaagatgagtaaaaaagaatcctcctttgtctgggcttgttccatcttccaaatatgtagcagcaacataatgacactaaaaactgccctaaaaatctgtaacagaaaaaaaaaatagcttacatgctactcaaaaaattacctaaatacctctcaaaatcaaaacaaaaagcaaagtaaaaaataaaacaggacatacttgcaagaaaagatatgacctaaaggttgtatcttagccctgtttgttttttgaataaaatattaagttttaagcatttatttactgtttacatacattaggccttaccatattatcaggcactattctaagtattttacgaatagtactttatgtaatcctcatagctccacaagtatgagggtgtggtggctcatgcctgtaatcctagcactttggaaagcagactgcttaagtccaggagttcaagaccagcttaggcaacatggccataccctgtttctacaaaaaacaaaaaaattagccggggatggtggcctgcacctgtggtcccagctactcaggaggctgaggtgggaggatcacttgagcctgggagatcaaggctgcagtgagctgtgatcttaccactgcactccagactgggtgacagagcgagactctgtctaaaaaaaaaaaaagctaccattgttataccccattttatagattaggaaactgaggcacagaggtcacactaagccaagatcacacaacaaatagcggagctgatggagctgagattcaaatccaggcagtctggtgctggagtccatgtgtgtaatcactaagctattatatacaagtaattccttcaaatattaatatttgataacaattttgaactttgaagtttgcaaatatccacagcctgtatagttagaagtacaaaagtaatcacaaataacttttctaatacagattttaaattggaaaagatttctttgaatagctttacaacaaacatgtgtagacaaaagtagggataagaaagaaagactgttttttaaatgcatttgtcatgaatttactacctgggtaagcaaaaaacttgagctgtctcttttgaaagacataatttacaaatatgaatttatatattgtctagaggaaaagcacagtacaatttcaattaatgtttaattctatgactgactaaaatctttataatatttttaattaaagaagaaggtgaccgggacttaggtaagaaagcaaaattataacatttactacataacaagttttttgtttttttttttacataaacaagctttgtttcttacaaaaaaaaacaagcttcttcttttttttttttttttggatacagagtctcactctgtcgcacaggctacagcatagtgccgcagtctcggctcaatgaggcctctgcctcccgggttcaagcaattctcatgcctcagcctccctagtagctgggattacagacatgcaccactacacccaactaatttttgtatttttagtagagacagggtttccccatgttggccaggctggtctcgaactcctggcctcatctgatccgcctgcctcggcctcccaaagtgctgggattataggcatgagctactgtgctaggcctataaaaaagcttctttagggtaacttttttcttttttctgtaacagaataatcacattatttctcaagggaaataccatttactcaatttgtactctgaatgccatctaataaaacagcaaagccacaaccatgcagaatgtcagcacagcatgtctaactaaaactcactgtaagaaaaaaaaggaaaagagagctgatttcaaaggttctacatggctttgcacttcacatgctctgatgctgcagatatgagaagttgtaggtctaacataatttatatcttcttttaggatactttggcatttgtgaattgagaagtttggaaaacaactacgcaagtcacttctaatcctaaaattccaactacatgaaataaatattagtaagtactcagacacacacaatgtcaaaggctggccttgtggcaaaaaggaaatacagcaaaatcagtcaggttcccaccacggcactgatagcaagtctgttctcaaggttagtctctaaactgacacctggtaagtctgacaatgaaatatttgccaacaattaagtaaaggagatctctcctgataaatttttcataagtttcacataatacactttgatatttcctggaatgtttgtggccctcccctcactgcattgctctctcattttgttggctaatacatgttactaaagtcaatatatattcaactcatttttctctgcctcttggcccaatttaacacagctgatcctgttttcaaatgccttcatctgattttcttctcacctcctgacctttgtaggtcttttatgtgctcattaatgttggaattacttattttttccttaaccaagtttttcatctgtaaaatggatgtaatcttatgattttcttcatagtgttgcgagaattcagtaagattatgaatgtatagattttggcacagtatccaggacctaaattctctataaaggctaactactattactactatcaactcacagctagattagtgaaattgtgtcctgactttccatgcttattcttcctcttctccactcttctgctcataatataactagttttatttttatttatttattttttgagacagtgtctcactctgtcgcccaggctgggtgctgtggcacaatcatagctcactacaacccccacctcaagtgatcctcccacctcagcctcccagggagctgggaatacaggtgcgtgccaccacgccccactaatttttgaatttttgtgggtttttttggtagagatggggtttcattattgttgtccaggctggtctcgaattcctgagctcaagccatatacccgccttggcctcccaagtgctgggattacaggtgtgagccaccttgccaggcctagagagttttaataagcacaaatctgattatgtgcccctcaatctatccagaaacccattaatgcttttatagggcttttagaatacagacacatctcttactacttttgcccccaatccttccctatgctttaaccaaactgatttcaagcttcttgcttctttgatagtccctgctcactccatgagggcatttgtccacaatatttcccttgttggaaaccctctagtgacaatttggtcctaattttcctttagacctttgctaaaaagtcacttctgtcttgactaagtctggcctattttgcattttccttatactacgttcctatcccctagaacttctgtttgcagttacaaatttatatgagtgactactatttattattaatacacatttgtgtgtttcttccaacagacatctcagactaagctcctgatattcatccaacccaaacctgttcctttaacctcctttgccatctcagaaaatagcaatactattcttccagttgctgaggtcaaaacccttggactctcacacttcacatccatcagcaaattctattgtttccccagaattcaactacttttccccatttccactgatacccactgtggtcaaagcgctatcatcacttcctggattgctgtaatacctcttaacacatctccttgcttctttgacccaaccatttatcccttgcctacctacaagacagctagatgaatcctttaaaaatggcagatgtcattcctccactgaaaccttccaataacctgccatctgccaaggactgttgtgtaccctgctaaattaatatgttgaagcccgaatcctctcctcactcctatgtgactgtattggagacagtccttttaaggagataattaaggttaaatgaggtgatcagggtaaagccctgattccacagaactggtgcccttataagaaaagagacaacgctctctttatcatctgaggagacattgagaaggtactgtctgcaagccaaaaagaaaacccgaacatgatcatgctggcattctgatctcagacttccagcaggcagaactgtgagaaaatatatttctactgtttgagccacccaatctatgtattttgttatggcagcctgagctgactaacacactattctactaaaaaagtcaagtatgtctaacagccaaaaaaggtcctaaacattctgatctactacatcccatatcctaagctctctgatgtaattgcctttgattcttcacatctcttaagcaagttccagccaaactggcttacatgcaattccgtgagcatgctaagcatgctcctgcctttgggtctttggtttccctctgcttcagacactttttttcccaagaactcatatcactcacttccttactcaaatatcaccttctcagtgaggccatcctatggaaaattttatgatcctcatttcacacaaatatcccatttccctttccttagtactcactgcttggatgctatgtattttacctatttatcttgtctattgtttctctttctcactagaaagaactccatgagagatgggattgtccgttttgctcactgctatatcccgtaaatacagagtagctcatagtacctgttcagtatttattcaactaaatgaatgttgaattccaatagtggcagaattcgttgtggagctgaaaggtactgcacggatcaactactaatgcagcaattccctagtagaaaactgcactgcttaaaggaccacctcatttttctggcctcctctggttattactaaagctcaaaaggagctttaaaaatcctgatgcaacagctgttttcccctctcaccgtctttaaaaatagagataataaaatagcctgaaaagttgtcaagttcaagtaagatcatgtttatgacaattttttgaaaattgcctggttgcagcttttacttacagcattttcaaacagttctgccaactctgtggctctttcatcatgtttcaagtgttcagcaaacgatggtgttcgtctccataaagtcaaagtttaaaaatacaagggccgggcgcggtggctcatgcctgtaatcccagcacttggagaggcggaggtgggcggatcacgaggtcaggagatcgagaccatcctggctaacacggtgaaaccccgactctactaaaaatacaaaaaattagcagggcgtgatggcgggcgcctgtagtcccaactactcaggaggctgaggcaggaggagaatggcgtgaacccaggaggcggagtttgcagtgagccaagatcgcacccctgcactacagcttgggcgacagagcgagactccgtctcaaaaaaaaaaaaaaaaagtacataaataaaaaccaagtaattggaggacgccattcattgattttacttaggactttgggcataatctataggtttaaaaatttctgctgctaagaaagtgggaacacagttatattcccttacattttaccgaagagaaactagacctgcagaggagtacctttctgtttctatataagcagaggaattctgcacaacccaaatcacgcagaaacctcctggtaaggactccacgggtagttattgccggcattgtattctgagagatgagctgcatatcacttttggaaatgccttaaattaaaactcgtcttgaaacaacatgacgtctcaaagaagctcccttctcaccttggaacatcagcttttaaaataaaggtgtcatcagaagtgtgtagacacccactgcatcacaactggaactgatctctggttatgccaatctaggtctgcctggcagggtgagtctaccgctcgaaagctgcacagaggaaatcctccctcctccaggttcaggcccggagttacgagcggagattcgcggcggcgggtcagagcccagagcaaaccaggctggggaacgcacctcgcccgcggctccggaagcggctgcggccccgaccggaaagcccccagcatcgcccgaaggaatcgcggctggcctgcggctccggcccggcctcgggtacca

SEQ ID NO: 405 - DNA, 683650 bp, Homo sapiens
  misc_feature (268290)..(368289): n is a, c, g, or t
cactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca
